(12) United States Patent
Pierce et al.

(10) Patent No.: US 12,258,411 B2
(45) Date of Patent: Mar. 25, 2025

(54) ANTI-CCR8 ANTIBODIES AND USES THEREOF

(71) Applicants: AMGEN INC., Thousand Oaks, CA (US); AMGEN RESEARCH (MUNICH) GmbH, Munich (DE)

(72) Inventors: Nathan William Pierce, Mountain View, CA (US); Agnieszka Kielczewska, Vancouver (CA); Wentao Chen, Thousand Oaks, CA (US); Olivier Nolan-Stevaux, Millbrae, CA (US); Darren L. Bates, Oak Park, CA (US); Lisa Winkel, Munich (DE); Christoph Dahlhoff, Geretsried (DE); Tobias Raum, Eurasburg (DE); Claudia Bluemel, Munich (DE); Jonas Karl-Josef Honer, Munich (DE)

(73) Assignees: AMGEN INC., Thousand Oaks, CA (US); AMGEN RESEARCH (MUNICH) GmbH, Munich (DE)

( * ) Notice: Subject to any disclaimer, the term of this patent is extended or adjusted under 35 U.S.C. 154(b) by 0 days.

(21) Appl. No.: 17/831,398

(22) Filed: Jun. 2, 2022

(65) Prior Publication Data

US 2022/0403037 A1 Dec. 22, 2022

Related U.S. Application Data

(60) Provisional application No. 63/236,551, filed on Aug. 24, 2021, provisional application No. 63/197,271, filed on Jun. 4, 2021.

(51) Int. Cl.
C07K 16/28 (2006.01)
A61K 39/00 (2006.01)

(52) U.S. Cl.
CPC .... *C07K 16/2866* (2013.01); *A61K 2039/505* (2013.01); *C07K 2317/56* (2013.01); *C07K 2317/76* (2013.01); *C07K 2317/92* (2013.01)

(58) Field of Classification Search
None
See application file for complete search history.

(56) References Cited

U.S. PATENT DOCUMENTS 10,087,259 B1 10/2018 Rudensky et al.

FOREIGN PATENT DOCUMENTS

| CN | 110835371 A | 2/2020 |
|---|---|---|
| EP | 3431105 B1 | 1/2020 |
| EP | 3616720 B1 | 2/2021 |
| WO | 2007044756 A2 | 4/2007 |
| WO | 2008073160 A2 | 6/2008 |
| WO | 2016057841 A1 | 4/2016 |
| WO | 2017040344 A2 | 3/2017 |
| WO | 2018181425 A1 | 10/2018 |
| WO | 2020138489 A1 | 7/2020 |
| WO | 2021142002 A1 | 7/2021 |
| WO | 2021152186 A2 | 8/2021 |
| WO | 2021163064 A2 | 8/2021 |
| WO | 2021194942 A1 | 9/2021 |
| WO | 2021260206 A2 | 12/2021 |
| WO | 2021260208 A2 | 12/2021 |
| WO | 2021260209 A2 | 12/2021 |
| WO | 2021260210 A2 | 12/2021 |
| WO | 2022003156 A1 | 1/2022 |
| WO | 2022004760 A1 | 1/2022 |
| WO | 2022042690 A1 | 3/2022 |
| WO | 2022078277 A1 | 4/2022 |
| WO | 2022081718 A1 | 4/2022 |
| WO | 2022136647 A1 | 6/2022 |
| WO | 2022136649 A1 | 6/2022 |
| WO | 2022136650 A1 | 6/2022 |
| WO | WO 2022/256559 | * 12/2022 |
| WO | WO 2022/256563 | * 12/2022 |

OTHER PUBLICATIONS

Campbell et al., "Fc-Optimized Anti-CCR8 Antibody Depletes Regulatory T Cells in Human Tumor Models," Cancer Research, vol. 81, pp. 2983-2994 (2021).
European Patent Office, International Search Report in International Patent Application No. PCT/US2022/032011, dated Nov. 9, 2022.
European Patent Office, Written Opinion in International Patent Application No. PCT/US2022/032011, dated Nov. 9, 2022.
Qu et al., "Role of CCR8 and Other Chemokine Pathways in the Migration of Monocyte-derived Dendritic Cells to Lymph Nodes," Journal of Experimental Medicine, vol. 200(10), pp. 1231-1241 (2004).
Van Damme et al., "Therapeutic depletion of CCR8+ tumor-infiltrating regulatory T cells elicits antitumor immunity and synergizes with anti-PD-1 therapy," Journal for ImmunoTherapy of Cancer, vol. 9, pp. 1-16 (2021).
Yoshikawa et al., "S-531011, a novel anti-human CCR8 antibody: antibody screening and evaluation of biological profiles," J Immunother Cancer, vol. 9 (suppl 2), pp. A934 (2021).
Kuehnemuth et el., "CCL1 is a major regulatory T cell attracting factor in human breast cancer," BMC Cancer, 18:1278 (2018).
Louahed et al., "CCR8-dependent activation of the RAS/MAPK pathway mediates anti-apoptotic activity of I-309/CCL1 and vMIP-I," European J. of Immunology, 33(2): 494-501 (2003).
Plitas et al., "Regulatory T Cells Exhibit Distinct Features in Human Breast Cancer," Immunity, 45(5): 1122-1134 (2016).
Tanaka et al., "Targeting Treg cells in cancer immunotherapy," European J. of Immun., 49(8): 1140-1146 (2019).

(Continued)

*Primary Examiner* — Marianne P Allen
(74) *Attorney, Agent, or Firm* — Megan Thobe

(57) ABSTRACT

The present invention provides anti-CCR8 antibodies and antigen-binding fragments thereof, and methods of making and using said anti-CCR8 antibodies and antigen-binding fragments thereof.

29 Claims, 6 Drawing Sheets

Specification includes a Sequence Listing.

(56) References Cited

OTHER PUBLICATIONS

Tiffany et al., "Identification of CCR8: a human monocyte and thymus receptor for the CC chemokine I-309," J Exp Med, 186(1): 165-70 (1997).
Villarreal et al., "Targeting CCR8 Induces Protective Antitumor Immunity and Enhances Vaccine-Induced Responses in Colon Cancer," Cancer Res, 78 (18): 5340-5348 (2018).

* cited by examiner

ANTI-CCR8 ANTIBODIES AND USES THEREOF

CROSS REFERENCE TO RELATED APPLICATIONS

This application claims the benefit of U.S. Provisional Application No. 63/197,271, filed Jun. 4, 2021, and U.S. Provisional Application No. 63/236,551, filed Aug. 24, 2021, each of which is incorporated by reference herein in its entirety.

DESCRIPTION OF THE TEXT FILE SUBMITTED ELECTRONICALLY

The present application contains a Sequence Listing, which has been submitted electronically in ASCII format and is hereby incorporated by reference in its entirety. The computer readable format copy of the Sequence Listing, which was created Jun. 1, 2022, is named A-2656-US03-SEC_SeqListing_ST25.txt and is 1,618,219 bytes in size.

FIELD OF THE INVENTION

The present invention relates to the field of oncology. The present invention relates to anti-CCR8 antibodies having ADCC activity, and treatment of cancer patients with said antibodies. Anti-CCR8 antibodies of the present invention bind a unique epitope, and do not block ligand binding to CCR8. The present invention also relates to methods of treatment with a Treg depleting antibody and one or more of a bispecific T-cell engager molecule, an agonist of a T cell co-stimulatory receptor, and an antagonist of the PD-1/PD-L1 pathway.

BACKGROUND OF THE INVENTION

The C—C chemokine receptor type 8 (CCR8) is a member of the beta chemokine receptor family, and is a seven transmembrane G-protein-coupled receptor with a 35 amino acid extracellular N-terminus. CCL1 is a ligand for CCR8, ccr8 and CCL1-induced CCR8 signaling occurs via G proteins. CCL1 binding CCR8 results in intracellular calcium flux that can be inhibited by pertussis toxin. Downstream activation of the RAS/ERK1/2 MAP kinase pathway has been demonstrated in a CCR8 expressing cell line (see e.g., Louahed et al. (2003) "CCR8-dependent activation of the RAS/MAPK pathway mediates anti-apoptotic activity of I-309/CCL1 and vMIP-I", European J. of Immunology; 33(2): 494-501).

Chemokines and their receptors are important for the migration of various cell types into the inflammatory sites. Previous studies of CCR8 and its ligands suggest a role in the proper positioning of activated T cells within antigenic challenge sites and specialized areas of peripheral and lymphoid tissues. CCR8 may also contribute to regulation of monocyte chemotaxis and thymic cell apoptosis (Tiffany et al. (1997) "Identification of CCR8: a human monocyte and thymus receptor for the CC chemokine I-309", J Exp Med; July 7; 186(1):165-70).

Recent data in multiple tumor types have demonstrated CCR8 expression is a marker for tumor specific T regulatory (Treg) cells (see e.g., Plitas et al. (2016) "Regulatory T Cells Exhibit Distinct Features in Human Breast Cancer", Immunity; 45(5):1122-1134; Villarreal et al. (September 2018) "Targeting CCR8 Induces Protective Antitumor Immunity and Enhances Vaccine-Induced Responses in Colon Cancer" Tumor Biol. And Immun.). CCR8 is expressed with much higher prevalence and at higher levels on the surface of tumor-resident Tregs compared to circulating or normal tissue Tregs and conventional T effector (Teff) cells. Treg cell infiltration in solid tumors is associated with poor clinical outcome, and Tregs suppress the anti-cancer immune response through inhibition of Teff cell cytotoxicity.

Some data suggest that Treg suppression of the immune response in the tumor can be reduced by blocking CCR8 function, thereby promoting an inflammatory response and reduced tumor volume. Another therapeutic strategy is to deplete tumor Treg cells via anti-CCR8 antibody dependent cell killing (such as ADCC). For ADCC, anti-CCR8 antibodies may induce redirected T cell lysis of tumor-resident CCR8+ Tregs while sparing normal tissue Tregs that have little to no CCR8 expression by preferentially binding to CCR8 on tumor-resident Tregs and depleting these tumor-resident Tregs via ADCC (e.g., Tanaka et al. (2019) "Targeting Treg cells in cancer immunotherapy" European J. of Immun.; 49(8)1140-1146).

Treg depleting antibodies such as anti-CCR8 antibodies are known in the art. For example, PCT publication No. WO 2018/181425 describes an antibody against CCR8 having ADCC activity for use in treating cancer, and it discloses the commercially available rat anti-mouse CCR8 antibody (SA214G2).

There exists a need for alternative anti-CCR8 antibodies that 1) are able to bind human and cynomolgus monkey CCR8 on tumor-resident Treg cells; 2) lead to specific depletion of tumor-resident Treg cells; 3) demonstrate an acceptable pharmacokinetic profile (compared to anti-CCR8 antibodies that bind a different epitope), and/or 4) display sufficient potency for the treatment of cancer.

There also exists a need for anti-CCR8 antibodies that do not block binding of ligand (such as CCL1) to CCR8, and/or that bind an epitope on CCR8 wherein the epitope comprises at least one residue at positions 1-12 of SEQ ID NO. 31.

SUMMARY OF THE INVENTION

The present invention provides an antibody that binds to human C—C chemokine receptor type 8 (CCR8), or an antigen-binding fragment thereof, wherein said antibody, or antigen-binding fragment thereof, comprises: (a) a heavy chain complementarity-determining region (HCDR) 1 amino acid sequence of SEQ ID NO: 1; (b) an HCDR2 amino acid sequence of SEQ ID NO: 2; (c) an HCDR3 amino acid sequence of SEQ ID NO: 3; (d) a light chain complementarity-determining region (LCDR) 1 amino acid sequence of KSSQSVLYSSNNX$_1$NYLA (SEQ ID NO: 1235), wherein X$_1$ is K or R, (e) an LCDR2 amino acid sequence of SEQ ID NO: 5, and (f) an LCDR3 amino acid sequence of SEQ ID NO: 6. In some embodiments, the antibody or antigen-binding fragment comprises an LCDR1 amino acid sequence of SEQ ID NO: 4. In some embodiments, the antibody or antigen binding fragment comprises a heavy chain variable region (HCVR) amino acid sequence of SEQ ID NO: 13, and a light chain variable region (LCVR) comprising the amino acid sequence: DIVMTQSPDSLAVSLGERATINCKSSQSVLYSSNNX$_1$NYLA WYX$_2$QKPGQX$_3$PKLLISWASTRESGVPDRFSGSGSGTDFTLTINSLQAEDVAVYYCQQ YYSIPITFGGGTKVEIKR (SEQ ID NO: 1236), wherein X$_1$ is K or R, X$_2$ is H or Q, and/or X$_3$ is S or P. In some embodiments, the antibody or antigen-binding fragment comprises a heavy chain variable region (HCVR) amino acid sequence of SEQ ID NO: 13 and a light chain variable region (LCVR) amino acid sequence of SEQ ID NO: 14 or SEQ ID NO: 363. In some embodiments, the antibody or antigen-binding fragment comprises a heavy chain (HC) amino acid sequence of SEQ ID NO: 15 and a light chain (LC) amino acid sequence of SEQ ID NO: 16 or SEQ ID NO: 365. In other embodiments, the antibody or antigen-binding fragment comprises two HCs and two LCs, wherein both HCs comprise an amino acid sequence of SEQ ID NO: 15, and both LCs comprise an amino acid sequence of SEQ ID NO: 16. In some embodiments, the antibody or antigen-binding fragment comprises two HCs and two LCs, and wherein both HCs comprise an amino acid sequence of SEQ ID NO: 15, and both LCs comprise an amino acid sequence of SEQ ID NO: 365. In an embodiment, the antibody or antigen-binding fragment thereof, is an antibody.

The present invention provides an antibody that binds to human CCR8, or an antigen-binding fragment thereof, comprising a heavy chain (HC) and a light chain (LC), wherein the HC comprises a heavy chain variable region (HCVR) and wherein the LC comprises a light chain variable region (LCVR), wherein the HCVR comprises HCDR1, HCDR2, and HCDR3 and the LCVR comprises LCDR1, LCDR2, and LCDR3, and wherein HCDR1 comprises an amino acid sequence of SEQ ID NO: 1; HCDR2 comprises an amino acid sequence of SEQ ID NO: 2; HCDR3 comprises an amino acid sequence of SEQ ID NO: 3; LCDR1 comprises an amino acid sequence of SEQ ID NO: 4; LCDR2 comprises an amino acid sequence of SEQ ID NO: 5; and LCDR3 comprises an amino acid sequence of SEQ ID NO: 6. In an embodiment, the HCVR comprises an amino acid sequence of SEQ ID NO: 13, and the LCVR comprises an amino acid sequence of SEQ ID NO: 14 or SEQ ID NO: 365. In an embodiment, the LCVR comprises an amino acid sequence of SEQ ID NO: 14. In an embodiment, the LCVR comprises an amino acid sequence of SEQ ID NO: 365. In an embodiment, the HC has an amino acid sequence of SEQ ID NO: 15 or SEQ ID NO: 573, and the LC has an amino acid sequence given by SEQ ID NO: 16. In another embodiment, the antibody comprises two HCs and two LCs, wherein each HC has an amino acid sequence of SEQ ID NO: 15 or SEQ ID NO: 573, and each LC has an amino acid sequence of SEQ ID NO: 16. In an embodiment, the antibody or antigen-binding fragment thereof, is an antibody.

The present invention also provides an antibody that binds to human CCR8, or an antigen-binding fragment thereof, which comprises an HCDR1 amino acid sequence of SEQ ID NO: 839; an HCDR2 amino acid sequence of SEQ ID NO: 840; an HCDR3 amino acid sequence of SEQ ID NO: 841; an LCDR1 amino acid sequence of SEQ ID NO: 842; an LCDR2 amino acid sequence of SEQ ID NO: 843; and an LCDR3 amino acid sequence of SEQ ID NO: 844. In some embodiments, the antibody or antigen-binding fragment comprises an HCVR amino acid sequence of SEQ ID NO: 1017 and an LCVR amino acid sequence of SEQ ID NO: 1018. In some embodiments, the antibody comprises an HC amino acid sequence of SEQ ID NO: 1125 or SEQ ID NO: 1237 and an LC amino acid sequence of SEQ ID NO: 1126. In some embodiments, the antibody comprises an HC amino acid sequence of SEQ ID NO: 1125 and an LC amino acid sequence of SEQ ID NO: 1126. In some embodiments, the antibody comprises an HC amino acid sequence of SEQ ID NO: 1237 and an LC amino acid sequence of SEQ ID NO: 1126. For example, the antibody may comprise two HCs and two LCs, wherein both HCs comprise an amino acid sequence of SEQ ID NO: 1125 or SEQ ID NO: 1237, and both LCs comprise an amino acid sequence of SEQ ID NO: 1126. In an embodiment, the antibody or antigen-binding fragment thereof, is an antibody.

The present invention also provides an antibody that binds to human CCR8, or an antigen-binding fragment thereof, which comprises an HCDR1 amino acid sequence of SEQ ID NO: 845; an HCDR2 amino acid sequence of SEQ ID NO: 846; an HCDR3 amino acid sequence of SEQ ID NO: 847; an LCDR1 amino acid sequence of SEQ ID NO: 848; an LCDR2 amino acid sequence of SEQ ID NO: 849; and an LCDR3 amino acid sequence of SEQ ID NO: 850. In some embodiments, the antibody or antigen-binding fragment comprises an HCVR amino acid sequence of SEQ ID NO: 1019 and an LCVR amino acid sequence of SEQ ID NO: 1020. In some embodiments, the antibody comprises an HC amino acid sequence of SEQ ID NO: 1127 or SEQ ID NO: 1238 and an LC amino acid sequence of SEQ ID NO: 1128.

The present invention further provides an antibody that binds to human CCR8, or an antigen-binding fragment thereof, which comprises: (a) an HCDR1 amino acid sequence of $X_1X_2GX_4H$, (SEQ ID NO: 1233), wherein (i) $X_1$ is N, S, D, G, T, or R, (ii) $X_2$ is C, N, Y, S, or F, and (iii) $X_4$ is M or F; (b) an HCDR2 amino acid sequence of SEQ ID NOs: 648, 654, 660, 666, 672, 678, 684, 690, 696, 702, 708, 714, 720, 726, 732, 738, 744, 750, 756, 762, 768, 774, 780, 786, 792, 798, 804, 810, 816, 822, 828, 834, 840, 846, 852, 858, 867, 873, 879, 885, 891, 897, 903, 909, 915, 921, 927, 933, 939, or 945, or a variant thereof that comprises 1-4 amino acid substitutions or is at least 90% identical to any one of the foregoing HCDR2 amino acid sequences; (c) an HCDR3 amino acid sequence of SEQ ID NOs: 649, 655, 661, 667, 673, 679, 685, 691, 697, 703, 709, 715, 721, 727, 733, 739, 745, 751, 757, 763, 769, 775, 781, 787, 793, 799, 805, 811, 817, 823, 829, 835, 847, 853, 859, 868, 874, 880, 886, 892, 898, 904, 910, 916, 922, 928, 934, 940, or 946 or a variant thereof that comprises 1-4 amino acid substitutions or is at least 90% identical to any one of the foregoing HCDR3 amino acid sequences; (d) an LCDR1 amino acid sequence of SEQ ID NOs: 650, 656, 662, 668, 674, 680, 686, 692, 698, 704, 710, 716, 722, 728, 734, 740, 746, 752, 758, 764, 770, 776, 782, 788, 794, 800, 806, 812, 818, 824, 830, 836, 848, 854, 860, 863, 869, 875, 881, 887, 893, 899, 905, 911, 917, 923, 929, 935, or 941 or a variant thereof that comprises 1-4 amino acid substitutions or is at least 90% identical to any one of the foregoing LCDR1 amino acid sequences; (e) an LCDR2 amino acid sequence of $RX_2X_3X_4RPS$ (SEQ ID NO: 1234), wherein (i) $X_2$ is A, N, D, S, or Q, (ii) $X_3$ is S, T, N, I, F, or A, and (iii) $X_4$ is N or V; and (f) an LCDR3 amino acid sequence of SEQ ID NOs: 652, 658, 664, 670, 676, 682, 688, 694, 700, 706, 712, 718, 724, 730, 736, 742, 748, 754, 760, 766, 772, 778, 784, 790, 796, 802, 808, 814, 820, 826, 832, 838, 850, 856, 862, 865, 871, 877, 883, 889, 895, 901, 907, 913, 919, 925, 931, 937, or 943 or a variant thereof that comprises 1-4 amino acid substitutions or is at least 90% identical to any one of the foregoing LCDR3 amino acid sequences. In some embodiments, the HCDR1 comprises an amino acid sequence of SEQ ID NOs: 647, 653, 659, 665, 671, 677, 683, 689, 695, 701, 707, 713, 719, 725, 731, 737, 743, 749, 755, 761, 767, 773, 779, 785, 791, 797, 803, 809, 815, 821, 827, 833, 845, 851, 857, 866, 872, 878, 884, 890, 896, 902, 908, 914, 920, 926, 932, 938, or 944. In some embodiments, the LCDR2 comprises an amino acid sequence of SEQ ID NOs: 651, 657, 663, 669, 675, 681, 687, 693, 699, 705, 711, 717, 723, 729, 735, 741, 747, 753, 759, 765, 771, 777, 783, 789, 795, 801, 807, 813, 819, 825, 831, 837 849, 855, 861, 864, 870, 876, 882, 888, 894, 900, 906, 912, 918, 924, 930, 936, or 942. In some embodiments, the HCVR comprises an amino acid sequence of SEQ ID NOs: 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1019, 1021, 1023, 1026, 1028, 1030, 1032, 1034, 1036, 1038, 1040, 1042, 1044, 1046, 1048, 1050, or 1052. In some embodiments, the LCVR comprises an amino acid sequence of SEQ ID NOs: 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1020, 1022, 1024, 1025, 1027, 1029, 1031, 1033, 1035, 1037, 1039, 1041, 1043, 1045, 1047, 1049, or 1051. In an embodiment, the antibody or antigen-binding fragment thereof, is an antibody.

In some embodiments, the antibody of or antigen-binding fragment comprises: (a) a HCVR comprising an amino acid sequence of SEQ ID NO: 1019 and a LCVR comprising an amino acid sequence of SEQ ID NO: 1020; (b) a HCVR comprising an amino acid sequence of SEQ ID NO: 1021 and a LCVR comprising an amino acid sequence of SEQ ID NO: 1022; (c) a HCVR comprising an amino acid sequence of SEQ ID NO: 1023 and a LCVR comprising an amino acid sequence of SEQ ID NO: 1024; (d) a HCVR comprising an amino acid sequence of SEQ ID NO: 1026 and a LCVR comprising an amino acid sequence of SEQ ID NO: 1025; (e) a HCVR comprising an amino acid sequence of SEQ ID NO: 1028 and a LCVR comprising an amino acid sequence of SEQ ID NO: 1027; (f) a HCVR comprising an amino acid sequence of SEQ ID NO: 1030 and a LCVR comprising an amino acid sequence of SEQ ID NO: 1029; (g) a HCVR comprising an amino acid sequence of SEQ ID NO: 1032 and a LCVR comprising an amino acid sequence of SEQ ID NO: 1031; (h) a HCVR comprising an amino acid sequence of SEQ ID NO: 1034 and a LCVR comprising an amino acid sequence of SEQ ID NO: 1033; (i) a HCVR comprising an amino acid sequence of SEQ ID NO: 1036 and a LCVR comprising an amino acid sequence of SEQ ID NO: 1035; (j) a HCVR comprising an amino acid sequence of SEQ ID NO: 1038 and a LCVR comprising an amino acid sequence of SEQ ID NO: 1037; (k) a HCVR comprising an amino acid sequence of SEQ ID NO: 1040 and a LCVR comprising an amino acid sequence of SEQ ID NO: 1039; (l) a HCVR comprising an amino acid sequence of SEQ ID NO: 1042 and a LCVR comprising an amino acid sequence of SEQ ID NO: 1041; (m) a HCVR comprising an amino acid sequence of SEQ ID NO: 1044 and a LCVR comprising an amino acid sequence of SEQ ID NO: 1043; (n) a HCVR comprising an amino acid sequence of SEQ ID NO: 1046 and a LCVR comprising an amino acid sequence of SEQ ID NO: 1045; (o) a HCVR comprising an amino acid sequence of SEQ ID NO: 1048 and a LCVR comprising an amino acid sequence of SEQ ID NO: 1047; (p) a HCVR comprising an amino acid sequence of SEQ ID NO: 1050 and a LCVR comprising an amino acid sequence of SEQ ID NO: 1049; or (q) a HCVR comprising an amino acid sequence of SEQ ID NO: 1052 and a LCVR comprising an amino acid sequence of SEQ ID NO: 1051. In an embodiment, the antibody or antigen-binding fragment thereof, is an antibody.

In some embodiments, the antibody comprises an HC amino acid sequence of SEQ ID NOs: 1127, 1129, 1131, 1134, 1136, 1138, 1140, 1142, 1144, 1146, 1148, 1150, 1152, 1154, 1156, 1158, 1160, or 1238-1254; and an LC amino acid sequence of SEQ ID NOs: 1128, 1130, 1132, 1133, 1135, 1137, 1139, 1141, 1143, 1145, 1147, 1149, 1151, 1153, 1155, 1157, or 1159. For example, in some embodiments, the antibody comprises: (a) an HC amino acid sequence of SEQ ID NO: 1127 or SEQ ID NO: 1238 and a LC amino acid sequence of SEQ ID NO: 1128; (b) an HC amino acid sequence of SEQ ID NO: 1129 or SEQ ID NO: 1239 and a LC amino acid sequence of SEQ ID NO: 1130; (c) an HC amino acid sequence of SEQ ID NO: 1131 or SEQ ID NO: 1240 and a LC amino acid sequence of SEQ ID NO: 1132; (d) an HC amino acid sequence of SEQ ID NO: 1134 or SEQ ID NO: 1241 and a LC amino acid sequence of SEQ ID NO: 1133; (e) an HC amino acid sequence of SEQ ID NO: 1136 or SEQ ID NO: 1242 and a LC amino acid sequence of SEQ ID NO: 1135; (0 an HC amino acid sequence of SEQ ID NO: 1138 or SEQ ID NO: 1243 and a LC amino acid sequence of SEQ ID NO: 1137; (g) an HC amino acid sequence of SEQ ID NO: 1140 or SEQ ID NO: 1244 and a LC amino acid sequence of SEQ ID NO: 1139; (h) an HC amino acid sequence of SEQ ID NO: 1142 or SEQ ID NO: 1245 and a LC amino acid sequence of SEQ ID NO: 1141; (i) an HC amino acid sequence of SEQ ID NO: 1144 or SEQ ID NO: 1246 and a LC amino acid sequence of SEQ ID NO: 1143; (j) an HC amino acid sequence of SEQ ID NO: 1146 or SEQ ID NO: 1247 and a LC amino acid sequence of SEQ ID NO: 1145; (k) an HC amino acid sequence of SEQ ID NO: 1148 or SEQ ID NO: 1248 and a LC amino acid sequence of SEQ ID NO: 1147; (1) an HC amino acid sequence of SEQ ID NO: 1150 or SEQ ID NO: 1249 and a LC amino acid sequence of SEQ ID NO: 1149; (m) an HC amino acid sequence of SEQ ID NO: 1152 or SEQ ID NO: 1250 and a LC amino acid sequence of SEQ ID NO: 1151; (n) an HC amino acid sequence of SEQ ID NO: 1154 or SEQ ID NO: 1251 and a LC amino acid sequence of SEQ ID NO: 1153; (o) an HC amino acid sequence of SEQ ID NO: 1156 or SEQ ID NO: 1252 and a LC amino acid sequence of SEQ ID NO: 1155; (p) an HC amino acid sequence of SEQ ID NO: 1158 or SEQ ID NO: 1253 and a LC amino acid sequence of SEQ ID NO: 1157; or (q) an HC amino acid sequence of SEQ ID NO: 1160 or SEQ ID NO: 1254 and a LC amino acid sequence of SEQ ID NO: 1159. In an embodiment, the antibody or antigen-binding fragment thereof, is an antibody.

In some embodiments, the antibody or antigen-binding fragment thereof is an antibody. In some embodiments, the antibody or antigen-binding fragment thereof is an antigen-binding fragment thereof. In some embodiments, the antibody or antigen-binding fragment is a single chain variable fragment (scFv). In some embodiments, the antibody or antigen-binding fragment is a Fab. In particular embodiments, the antibody or antigen-binding fragment is a single chain Fab (scFab). In some embodiments, the antigen-binding fragment comprises an amino acid sequence of any one of the anti-CCR8 antibodies or antigen-binding fragments thereof of the present invention.

The present invention also provides an antibody or antigen-binding fragment thereof, that binds to human CCR8, comprising a heavy chain (HC) and a light chain (LC), wherein the HC comprises a heavy chain variable region (HCVR) and wherein the LC comprises a light chain variable region (LCVR), wherein the HCVR comprises HCDR1, HCDR2, and HCDR3 and the LCVR comprises LCDR1, LCDR2, and LCDR3, and wherein HCDR1 comprises an amino acid sequence of SEQ ID NO: 7; HCDR2 comprises an amino acid sequence of SEQ ID NO: 8, SEQ ID NO: 367, or SEQ ID NO: 377; HCDR3 comprises an amino acid sequence of SEQ ID NO: 9; LCDR1 comprises an amino acid sequence of SEQ ID NO: 10, SEQ ID NO: 369, or SEQ ID NO: 379; LCDR2 comprises an amino acid sequence of SEQ ID NO: 11; and LCDR3 comprises an amino acid sequence of SEQ ID NO: 12. In an embodiment, the HCDR2 comprises an amino acid sequence of SEQ ID NO: 8. In an embodiment, the HCDR2 comprises an amino acid sequence of SEQ ID NO: 367. In an embodiment, the HCDR2 comprises an amino acid sequence of SEQ ID NO: 377. In an embodiment, the LCDR1 comprises an amino acid sequence of SEQ ID NO: 10. In an embodiment, the LCDR1 comprises an amino acid sequence of SEQ ID NO: 369. In an embodiment, the LCDR1 comprises an amino acid sequence of SEQ ID NO: 379. In an embodiment, the HCVR comprises an amino acid sequence of SEQ ID NO: 17, SEQ ID NO: 372, or SEQ ID NO: 382, and the LCVR comprises an amino acid sequence of SEQ ID NO: 18, SEQ ID NO: 373, or SEQ ID NO: 383. In an embodiment, the HCVR comprises an amino acid sequence of SEQ ID NO: 17. In an embodiment, the HCVR comprises an amino acid sequence of SEQ ID NO: 372. In an embodiment, the HCVR comprises an amino acid sequence of SEQ ID NO: 382. In an embodiment, the LCVR comprises an amino acid sequence of SEQ ID NO: 18. In an embodiment, the LCVR comprises an amino acid sequence of SEQ ID NO: 373. In an embodiment, the LCVR comprises an amino acid sequence of SEQ ID NO: 383. In an embodiment, the HC comprises an amino acid sequence of SEQ ID NO: 19, SEQ ID NO: 374, or SEQ ID NO: 384, and the LC comprises an amino acid sequence of SEQ ID NO: 20, SEQ ID NO: 375, or SEQ ID NO: 385. In an embodiment, the HC comprises an amino acid sequence of SEQ ID NO: 19. In an embodiment, the HC comprises an amino acid sequence of SEQ ID NO: 374. In an embodiment, the HC comprises an amino acid sequence of SEQ ID NO: 384. In an embodiment, the LC comprises an amino acid sequence of SEQ ID NO: 20. In an embodiment, the LC comprises an amino acid sequence of SEQ ID NO: 375. In an embodiment, the LC comprises an amino acid sequence of SEQ ID NO: 385. In another embodiment, the antibody comprises two HCs and two LCs, wherein each HC comprises an amino acid sequence of SEQ ID NO: 19, SEQ ID NO: 374, or SEQ ID NO: 384, and each LC comprises an amino acid sequence of SEQ ID NO: 20, SEQ ID NO: 375, or SEQ ID NO: 385. In an embodiment, each HC comprises an amino acid sequence of SEQ ID NO: 19. In an embodiment, each HC comprises an amino acid sequence of SEQ ID NO: 374. In an embodiment, each HC comprises an amino acid sequence of SEQ ID NO: 384. In an embodiment, each LC comprises an amino acid sequence of SEQ ID NO: 20. In an embodiment, each LC comprises an amino acid sequence of SEQ ID NO: 375. In an embodiment, each LC comprises an amino acid sequence of SEQ ID NO: 385. In an embodiment, the antibody or antigen-binding fragment thereof, is an antibody.

The present invention provides an antibody or antigen-binding fragment thereof, that binds CCR8, wherein the antibody or antigen-binding fragment comprises HCDR1, HCDR2, HCDR3, LCDR1, LCDR2, LCDR3 comprising amino acid sequences of SEQ ID NO: 1; SEQ ID NO: 2; SEQ ID NO: 3; SEQ ID NO: 4; SEQ ID NO: 5; and SEQ ID NO: 6, respectively. In an embodiment, the antibody or antigen-binding fragment comprises an HCVR and LCVR comprising amino acid sequences of SEQ ID NO: 352 and SEQ ID NO: 353, respectively. In another embodiment, the antibody comprises an HC and LC comprising the amino acid sequences of SEQ ID NO: 354 and 355, respectively. In another embodiment, the antibody comprises an HC and LC comprising the amino acid sequences of SEQ ID NO: 573 and 355, respectively. In an embodiment, the antibody is Antibody 1 IgG1. In an embodiment, the antibody or antigen-binding fragment thereof, is an antibody.

The present invention provides an antibody or antigen-binding fragment thereof, that binds CCR8, wherein the antibody or antigen-binding fragment comprises HCDR1, HCDR2, HCDR3, LCDR1, LCDR2, LCDR3 comprising amino acid sequences of SEQ ID NO: 1; SEQ ID NO: 2; SEQ ID NO: 3; SEQ ID NO: 4; SEQ ID NO: 5; and SEQ ID NO: 6, respectively. In an embodiment, the antibody or antigen-binding fragment comprises an HCVR and LCVR comprising amino acid sequences of SEQ ID NO: 362 and SEQ ID NO: 363, respectively. In another embodiment, the antibody comprises an HC and LC comprising the amino acid sequences of SEQ ID NO: 364 and 365, respectively. In another embodiment, the antibody comprises an HC and LC comprising the amino acid sequences of SEQ ID NO: 574 and 365, respectively. In an embodiment, the antibody is Antibody 1.1 IgG1. In an embodiment, the antibody or antigen-binding fragment thereof, is an antibody.

The present invention provides an antibody or antigen-binding fragment thereof that binds CCR8, wherein the antibody or antigen-binding fragment comprises HCDR1, HCDR2, HCDR3, LCDR1, LCDR2, LCDR3 comprising amino acid sequences of SEQ ID NO: 366; SEQ ID NO: 367; SEQ ID NO: 368; SEQ ID NO: 369; SEQ ID NO: 370; and SEQ ID NO: 371, respectively. In an embodiment, the antibody or antigen-binding fragment comprises an HCVR and LCVR comprising amino acid sequences of SEQ ID NO: 372 and SEQ ID NO: 373, respectively. In another embodiment, the antibody comprises an HC and LC comprising the amino acid sequences of SEQ ID NO: 374 and 375, respectively. In another embodiment, the antibody comprises an HC and LC comprising the amino acid sequences of SEQ ID NO: 575 and 375, respectively. In an embodiment, the antibody is Antibody 2.1 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 376; SEQ ID NO: 377; SEQ ID NO: 378; SEQ ID NO: 379; SEQ ID NO: 380; and SEQ ID NO: 381, respectively. In an embodiment, the antibody or antigen-binding fragment comprises an HCVR and LCVR comprising amino acid sequences of SEQ ID NO: 382 and SEQ ID NO: 383, respectively. In another embodiment, the antibody comprises an HC and LC comprising the amino acid sequences of SEQ ID NO: 384 and 385, respectively. In another embodiment, the antibody comprises an HC and LC comprising the amino acid sequences of SEQ ID NO: 576 and 385, respectively. In an embodiment, the antibody is Antibody 2.2 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 386; SEQ ID NO: 387; SEQ ID NO: 388; SEQ ID NO: 389; SEQ ID NO: 390; and SEQ ID NO: 391, respectively. In an embodiment, the antibody or antigen-binding fragment comprises an HCVR and an LCVR comprising amino acid sequences of SEQ ID NO: 392 and SEQ ID NO: 393, respectively. In another embodiment, the antibody comprises an HC and LC comprising the amino acid sequences of SEQ ID NO: 394 and 395, respectively. In another embodiment, the antibody comprises an HC and LC comprising the amino acid sequences of SEQ ID NO: 577 and 395, respectively. In an embodiment, the antibody is Antibody 3.0 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 396; SEQ ID NO: 397; SEQ ID NO: 398; SEQ ID NO: 399; SEQ ID NO: 400; and SEQ ID NO: 401; respectively. In an embodiment, the antibody or antigen-binding fragment comprises an HCVR and LCVR comprising amino acid sequences of SEQ ID NO: 402 and SEQ ID NO: 403, respectively. In another embodiment, the antibody comprises an HC and LC comprising the amino acid sequences of SEQ ID NO: 404 and 405, respectively. In another embodiment, the antibody comprises an HC and LC comprising the amino acid sequences of SEQ ID NO: 578 and 405, respectively. In an embodiment, the antibody is Antibody 4.0 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 406; SEQ ID NO: 407; SEQ ID NO: 408; SEQ ID NO: 409; SEQ ID NO: 410; and SEQ ID NO: 411; respectively. In an embodiment, the antibody or antigen-binding fragment comprises an HCVR and LCVR comprising amino acid sequences of SEQ ID NO: 412 and SEQ ID NO: 413, respectively. In another embodiment, the antibody comprises an HC and LC comprising the amino acid sequences of SEQ ID NO: 414 and 415, respectively. In another embodiment, the antibody comprises an HC and LC comprising the amino acid sequences of SEQ ID NO: 579 and 415, respectively. In an embodiment, the antibody is Antibody 4.1 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 416; SEQ ID NO: 417; SEQ ID NO: 418; SEQ ID NO: 419; SEQ ID NO: 420; and SEQ ID NO: 421, respectively. In an embodiment, the antibody or antigen-binding fragment comprises an HCVR and LCVR comprising amino acid sequences of SEQ ID NO: 422 and SEQ ID NO: 423, respectively. In another embodiment, the antibody comprises HC and LC comprising amino acid sequences of SEQ ID NO: 424 and 425, respectively. In another embodiment, the antibody comprises an HC and LC comprising the amino acid sequences of SEQ ID NO: 580 and 425, respectively. In an embodiment, the antibody is Antibody 4.2 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 426, SEQ ID NO: 427, SEQ ID NO: 428, SEQ ID NO: 429, SEQ ID NO: 430, and SEQ ID NO: 431, respectively. In an embodiment, the antibody or antigen-binding fragment comprises an HCVR and LCVR comprising amino acid sequences of SEQ ID NO: 432 and SEQ ID NO: 433, respectively. In another embodiment, the antibody comprises an HC and LC comprising amino acid sequences of SEQ ID NO: 434 and 435, respectively. In another embodiment, the antibody comprises an HC and LC comprising the amino acid sequences of SEQ ID NO: 581 and 435, respectively. In an embodiment, the antibody is Antibody 5.0 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 436, SEQ ID NO: 437, SEQ ID NO: 438, SEQ ID NO: 439, SEQ ID NO: 440, and SEQ ID NO: 441, respectively. In an embodiment, the antibody or antigen-binding fragment comprises HCVR and LCVR comprising amino acid sequences of SEQ ID NO: 442 and SEQ ID NO: 443, respectively. In another embodiment, the antibody comprises an HC and LC comprising the amino acid sequences of SEQ ID NO: 444 and 445, respectively. In another embodiment, the antibody comprises an HC and LC comprising the amino acid sequences of SEQ ID NO: 582 and 445, respectively. In an embodiment, the antibody is Antibody 5.1 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 446; SEQ ID NO: 447; SEQ ID NO: 448; SEQ ID NO: 449; SEQ ID NO: 450; and SEQ ID NO: 451, respectively. In an embodiment, the antibody or antigen-binding fragment comprises an HCVR and LCVR comprising amino acid sequences of SEQ ID NO: 452 and SEQ ID NO: 453, respectively. In another embodiment, the antibody comprises an HC and LC comprising the amino acid sequences of SEQ ID NO: 454 and 455, respectively. In another embodiment, the antibody comprises an HC and LC comprising the amino acid sequences of SEQ ID NO: 583 and 455, respectively. In an embodiment, the antibody is Antibody 5.2 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 456, SEQ ID NO: 457, SEQ ID NO: 458, SEQ ID NO: 459, SEQ ID NO: 460, and SEQ ID NO: 461, respectively. In an embodiment, the antibody or antigen-binding fragment comprises an HCVR and LCVR comprising the amino acid sequences of SEQ ID NO: 462 and SEQ ID NO: 463, respectively. In another embodiment, the antibody comprises an HC and LC comprising the amino acid sequences of SEQ ID NO: 464 and 465, respectively. In another embodiment, the antibody comprises an HC and LC comprising the amino acid sequences of SEQ ID NO: 584 and 465, respectively. In an embodiment, the antibody is Antibody 5.3 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 466, SEQ ID NO: 467, SEQ ID NO: 468, SEQ ID NO: 469, SEQ ID NO: 470, and SEQ ID NO: 471, respectively. In an embodiment, the antibody or antigen-binding fragment comprises an HCVR and LCVR comprising the amino acid sequences of SEQ ID NO: 472 and SEQ ID NO: 473, respectively. In another embodiment, the antibody comprises an HC and LC comprising the amino acid sequences of SEQ ID NO: 474 and 475, respectively. In another embodiment, the antibody comprises an HC and LC comprising the amino acid sequences of SEQ ID NO: 585 and 475, respectively. In an embodiment, the antibody is Antibody 5.4 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 476, SEQ ID NO: 477, SEQ ID NO: 478, SEQ ID NO: 479, SEQ ID NO: 480, and SEQ ID NO: 481, respectively. In an embodiment, the antibody or antigen-binding fragment comprises an HCVR and LCVR comprising amino acid sequences of SEQ ID NO: 482 and SEQ ID NO: 483, respectively. In another embodiment, the antibody comprises an HC and LC comprising the amino acid sequences of SEQ ID NO: 484 and 485, respectively. In another embodiment, the antibody comprises an HC and LC comprising the amino acid sequences of SEQ ID NO: 586 and 485, respectively. In an embodiment, the antibody is Antibody 5.5 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 486; SEQ ID NO: 487; SEQ ID NO: 488; SEQ ID NO: 489; SEQ ID NO: 490; and SEQ ID NO: 491, respectively. In an embodiment, the antibody or antigen-binding fragment comprises an HCVR and LCVR comprising amino acid sequences of SEQ ID NO: 492 and SEQ ID NO: 493, respectively. In another embodiment, the antibody comprises an HC and LC comprising the amino acid sequences of SEQ ID NO: 494 and 495, respectively. In another embodiment, the antibody comprises an HC and LC comprising the amino acid sequences of SEQ ID NO: 587 and 495, respectively. In an embodiment, the antibody is Antibody 5.6 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 496; SEQ ID NO: 497; SEQ ID NO: 498; SEQ ID NO: 499; SEQ ID NO: 500; and SEQ ID NO: 501, respectively. In an embodiment, the antibody or antigen-binding fragment comprises an HCVR and LCVR comprising amino acid sequences of SEQ ID NO: 502 and SEQ ID NO: 503, respectively. In another embodiment, the antibody comprises an HC and LC comprising the amino acid sequences of SEQ ID NO: 504 and 505, respectively. In another embodiment, the antibody comprises an HC and LC comprising the amino acid sequences of SEQ ID NO: 588 and 505, respectively. In an embodiment, the antibody is Antibody 5.7 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 506; SEQ ID NO: 507; SEQ ID NO: 508; SEQ ID NO: 509; SEQ ID NO: 510; and SEQ ID NO: 511; respectively. In an embodiment, the antibody or antigen-binding fragment comprises an HCVR and LCVR comprising amino acid sequences of SEQ ID NO: 512 and SEQ ID NO: 513, respectively. In another embodiment, the antibody comprises an HC and LC comprising the amino acid sequences of SEQ ID NO: 514 and 515, respectively. In another embodiment, the antibody comprises an HC and LC comprising the amino acid sequences of SEQ ID NO: 589 and 515, respectively. In an embodiment, the antibody is Antibody 5.8 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 516; SEQ ID NO: 517; SEQ ID NO: 518; SEQ ID NO: 519; SEQ ID NO: 520; and SEQ ID NO: 521, respectively. In an embodiment, the antibody or antigen-binding fragment comprises HCVR and LCVR comprising amino acid sequences of SEQ ID NO: 522 and SEQ ID NO: 523, respectively. In another embodiment, the antibody comprises an HC and LC comprising the amino acid sequences of SEQ ID NO: 524 and 525, respectively. In another embodiment, the antibody comprises an HC and LC comprising the amino acid sequences of SEQ ID NO: 590 and 525, respectively. In an embodiment, the antibody is Antibody 5.9 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 526; SEQ ID NO: 527; SEQ ID NO: 528; SEQ ID NO: 529; SEQ ID NO: 530; and SEQ ID NO: 531; respectively. In an embodiment, the antibody or antigen-binding fragment comprises an HCVR and LCVR comprising amino acid sequences of SEQ ID NO: 532 and SEQ ID NO: 533, respectively. In another embodiment, the antibody comprises an HC and LC comprising the amino acid sequences of SEQ ID NO: 534 and 535, respectively. In another embodiment, the antibody comprises an HC and LC comprising the amino acid sequences of SEQ ID NO: 591 and 535, respectively. In an embodiment, the antibody is Antibody 6.0 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 536; SEQ ID NO: 537; SEQ ID NO: 538; SEQ ID NO: 539; SEQ ID NO: 540; and SEQ ID NO: 541, respectively. In an embodiment, the antibody or antigen-binding fragment comprises an HCVR and LCVR comprising the amino acid sequences of SEQ ID NO: 542 and SEQ ID NO: 543, respectively. In another embodiment, the antibody comprises an HC and LC comprising the amino acid sequences of SEQ ID NO: 544 and 545, respectively. In another embodiment, the antibody comprises an HC and LC comprising the amino acid sequences of SEQ ID NO: 592 and 545, respectively. In an embodiment, the antibody is Antibody 6.1 IgG1. In an embodiment, the antibody or antigen-binding fragment thereof, is an antibody.

The present invention provides an antibody or antigen-binding fragment that binds CCR8, wherein the antibody or antigen-binding fragment comprises HCDR1, HCDR2, HCDR3, LCDR1, LCDR2, LCDR3 comprising amino acid sequences of SEQ ID NO: 546; SEQ ID NO: 547; SEQ ID NO: 548; SEQ ID NO: 549; SEQ ID NO: 550; and SEQ ID NO: 551, respectively. In an embodiment, the antibody or antigen-binding fragment comprises an HCVR and LCVR comprising amino acid sequences of SEQ ID NO: 552 and SEQ ID NO: 553, respectively. In another embodiment, the antibody comprises an HC and LC comprising the amino acid sequences of SEQ ID NO: 554 and 555, respectively. In another embodiment, the antibody comprises an HC and LC comprising the amino acid sequences of SEQ ID NO: 593 and 555, respectively. In an embodiment, the antibody is Antibody 6.2 IgG1. In an embodiment, the antibody or antigen-binding fragment thereof, is an antibody.

In some embodiments, the anti-CCR8 antibody or antigen-binding fragment thereof comprises HCDR1, HCDR2, HCDR3, LCDR1, LCDR2, LCDR3, HCVR, LCVR, HC, and/or LC amino acid residues as disclosed in Table 16, Table 17, Table 19, and/or Table 20.

In another embodiment, the HCDR1, HCDR2, HCDR3, LCDR1, LCDR2, and/or LCDR3 of an antibody or antigen-binding fragment of the present invention comprises a sequence of amino acids that is at least 70%, 75%, 80%, 85%, 90%, 91%, 92%, 93%, 94%, 95%, 96%, 97%, 98%, 99% or 100% identical to the sequence of a HCDR1, HCDR2, HCDR3, LCDR1, LCDR2, and/or LCDR3 sequence of an anti-CCR8 antibody or antigen-binding fragment of the present invention listed herein. In an embodiment, the sequence of amino acids is at least 70% identical. In an embodiment, the sequence of amino acids is at least 80% identical. In an embodiment, the sequence of amino acids is at least 90% identical. In another embodiment, the sequence of amino acids is at least 95% identical. In an embodiment, the antibody or antigen-binding fragment thereof, is an antibody.

In another embodiment, the HCVR and/or LCVR comprises a sequence of amino acids that is at least 70%, 75%, 80%, 85%, 90%, 91%, 92%, 93%, 94%, 95%, 96%, 97%, 98%, 99% or 100% identical to the sequence of a HCVR and/or LCVR sequence of an anti-CCR8 antibody or antigen-binding fragment of the present invention listed herein. In an embodiment, the sequence of amino acids is at least 70% identical. In an embodiment, the sequence of amino acids is at least 80% identical. In an embodiment, the sequence of amino acids is at least 90% identical. In another embodiment, the sequence of amino acids is at least 95% identical. In an embodiment, the antibody or antigen-binding fragment thereof, is an antibody.

In another embodiment, the HC and/or LC comprises a sequence of amino acids that is at least 70%, 75%, 80%, 85%, 90%, 91%, 92%, 93%, 94%, 95%, 96%, 97%, 98%, 99% or 100% identical to the sequence of a HC and/or LC sequence of an anti-CCR8 antibody or antigen-binding fragment of the present invention listed herein. In an embodiment, the sequence of amino acids is at least 70% identical. In an embodiment, the sequence of amino acids is at least 80% identical. In an embodiment, the sequence of amino acids is at least 90% identical. In another embodiment, the sequence of amino acids is at least 95% identical. In an embodiment, the antibody or antigen-binding fragment thereof, is an antibody.

In an embodiment, the present invention provides an afucosylated antibody of the present invention. In an embodiment, an anti-CCR8 antibody of the present invention is human or humanized.

In some embodiments, an anti-CCR8 antibody or antigen-binding fragment of the present invention can be administered concurrently with, before, or after a variety of drugs and treatments widely employed in cancer treatment such as, for example, chemotherapeutic agents, non-chemotherapeutic agents (e.g., checkpoint inhibitors including anti-PD-1 or anti-PD-L1 inhibitors, such as antagonist antibodies), anti-neoplastic agents, and/or radiation. For example, administration can occur before, during, and/or after any of the treatments described herein. Examples of chemotherapeutic agents are discussed herein and include, but are not limited to, cisplatin, taxol, etoposide, mitoxantrone (Novantrone®), actinomycin D, cycloheximide, camptothecin (or water soluble derivatives thereof), methotrexate, mitomycin (e.g., mitomycin C), dacarbazine (DTIC), anti-neoplastic antibiotics such as adriamycin (doxorubicin) and daunomycin, and all the chemotherapeutic agents mentioned herein. In an embodiment, the antibody or antigen-binding fragment thereof, is an antibody.

In some embodiments, an anti-CCR8 antibody or antigen-binding fragment of the present invention may be administered concurrently with, before, or after a checkpoint inhibitor such as a PD-1 antagonist antibody or a PD-L1 antagonist antibody. The term "PD-1 antagonist antibody" refers to an antibody that specifically binds to PD-1 and decreases, blocks, inhibits, abrogates, or interferes with signal transduction resulting from the interaction of PD-1 and one or more of its ligands, such as PD-L1 and PD-L2. In some embodiments, a PD-1 antagonist antibody inhibits the binding of PD-1 to PD-L1 and/or PD-L2. The term "PD-L1 antagonist antibody" refers to an antibody that specifically binds to PD-L1 and decreases, blocks, inhibits, abrogates, or interferes with signal transduction resulting from the interaction of PD-L1 with the PD-1 receptor. In some embodiments, a PD-L1 antagonist antibody inhibits the binding of PD-L1 to PD-1. In some embodiments, the PD-1 antagonist antibody is any one of Antibody 20C1.006 (comprising LCDR1, LCDR2, LCDR3, HCDR1, HCDR2, HCDR3 amino acid sequences of SEQ ID NOs 72-77, respectively; VL and VH amino acid sequences of SEQ ID NOs 78 and 79, respectively; and LC and HC amino acid sequences of SEQ ID NOs 80 and 81, respectively); zeluvalimab (comprising LCDR1, LCDR2, LCDR3, HCDR1, HCDR2, HCDR3 amino acid sequences of SEQ ID NOs 32-37, respectively; VL and VH amino acid sequences of SEQ ID NOs 38 and 39 respectively; LC amino acid sequence of SEQ ID NO: 40; and HC amino acid sequences of SEQ ID NOs 41 or 636); Antibody 20A2.003 (comprising LCDR1, LCDR2, LCDR3, HCDR1, HCDR2, HCDR3 amino acid sequences of SEQ ID NOs 42-47, respectively; VL and VH amino acid sequences of SEQ ID NOs 48 and 49, respectively; and LC and HC amino acid sequences of SEQ ID NOs 50 and 51, respectively); Antibody 22D4.006 (comprising LCDR1, LCDR2, LCDR3, HCDR1, HCDR2, HCDR3 amino acid sequences of SEQ ID NOs 52-57, respectively; VL and VH amino acid sequences of SEQ ID NOs 58 and 59, respectively; and LC and HC amino acid sequences of SEQ ID NOs 60 and 61, respectively); or Antibody 22D4.017 (comprising LCDR1, LCDR2, LCDR3, HCDR1, HCDR2, HCDR3 amino acid sequences of SEQ ID NOs 62-67, respectively; VL and VH amino acid sequences of SEQ ID NOs 68 and 69, respectively; and LC and HC amino acid sequences of SEQ ID NOs 70 and 71, respectively). In one embodiment, the PD-1 antagonist antibody is pembrolizumab. In another embodiment, the PD-1 antagonist antibody is nivolumab. In yet another embodiment, the PD-1 antagonist antibody is cemiplimab. In a particular embodiment, the PD-1 antagonist antibody is zeluvalimab. Zeluvalimab is also known as AMG 404 and is also known as 20C1.009. In an embodiment, the antibody or antigen-binding fragment thereof, is an antibody.

The present invention provides a method of treating cancer in a patient comprising administering an effective amount of an anti-CCR8 antibody or antigen-binding fragment, wherein the anti-CCR8 antibody or antigen-binding fragment does not block ligand binding to CCR8. In an embodiment, the antibody or antigen-binding fragment thereof, is an antibody.

The present invention provides a method of treating cancer in a patient comprising administering an effective amount of an anti-CCR8 antibody, wherein the anti-CCR8 antibody has ADCC.

The present invention provides a method of treating cancer in a patient comprising administering an effective amount of an anti-CCR8 antibody, wherein the anti-CCR8 antibody does not block ligand binding to CCR8 and wherein the anti-CCR8 antibody has ADCC. In an embodiment, the anti-CCR8 antibody further has an acceptable PK. In an embodiment, the anti-CCR8 antibody binds an epitope wherein the epitope comprises at least one residue at positions 1-12 of SEQ ID NO: 31. In an embodiment, the epitope comprises at least two residues at positions 1-12 of SEQ ID NO: 31. In an embodiment, the epitope comprises at least three residues at positions 1-12 of SEQ ID NO: 31. In an embodiment, the epitope comprises at least four residues at positions 1-12 of SEQ ID NO: 31. In an embodiment, the epitope comprises at least five residues at positions 1-12 of SEQ ID NO: 31. In an embodiment, the epitope comprises six or more residues at positions 1-12 of SEQ ID NO: 31. In an embodiment, the epitope comprises seven or more residues at positions 1-12 of SEQ ID NO: 31. In an embodiment, the epitope comprises eight or more residues at positions 1-12 of SEQ ID NO: 31. In an embodiment, the epitope comprises nine or more residues at positions 1-12 of SEQ ID NO: 31. In an embodiment, the epitope comprises ten or more residues at positions 1-12 of SEQ ID NO: 31. In an embodiment, the epitope comprises eleven or more residues at positions 1-12 of SEQ ID NO: 31. In an embodiment, the epitope comprises all twelve amino acid residues at positions 1-12 of SEQ ID NO: 31. In a particular embodiment, the epitope comprises a threonine at position 4 of SEQ ID NO: 31. In a particular embodiment, the epitope comprises a threonine at position 4 of SEQ ID NO: 22. The amino acid sequence of amino acid residues 1-12 of SEQ ID NO: 31 is SEQ ID NO: 82. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody binding to the T4R mutation in cynomolgus monkey CCR8. In an embodiment, binding to the T4R mutation is determined in a cell based affinity assay, wherein antibody binding to cells expressing cynomolgus monkey cells CCR8 containing a T4R mutation is compared to antibody binding to cells expressing wild-type cynomolgus monkey CCR8 (comprising a threonine at position four). In some embodiments, an anti-CCR8 antibody binds threonine at position four if it shows reduced binding to CCR8 comprising a T4R mutation. In particular embodiments, an anti-CCR8 antibody binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556.

The present invention provides a method of treating cancer in a patient comprising administering an effective amount of an anti-CCR8 antibody, wherein the anti-CCR8 antibody does not block ligand binding to CCR8 and wherein the anti-CCR8 antibody has ADCC. In an embodiment, the anti-CCR8 antibody further has an acceptable PK. In an embodiment, the anti-CCR8 antibody binds an epitope wherein the epitope consists of at least one residue at positions 1-12 of SEQ ID NO: 31. In an embodiment, the epitope consists of at least two residues at positions 1-12 of SEQ ID NO: 31. In an embodiment, the epitope consists of at least three residues at positions 1-12 of SEQ ID NO: 31. In an embodiment, the epitope consists of at least four residues at positions 1-12 of SEQ ID NO: 31. In an embodiment, the epitope comp consists of rises at least five residues at positions 1-12 of SEQ ID NO: 31. In an embodiment, the epitope consists of six or more residues at positions 1-12 of SEQ ID NO: 31. In an embodiment, the epitope consists of seven or more residues at positions 1-12 of SEQ ID NO: 31. In an embodiment, the epitope consists of eight or more residues at positions 1-12 of SEQ ID NO: 31. In an embodiment, the epitope consists of nine or more residues at positions 1-12 of SEQ ID NO: 31. In an embodiment, the epitope consists of ten or more residues at positions 1-12 of SEQ ID NO: 31. In an embodiment, the epitope consists of eleven or more residues at positions 1-12 of SEQ ID NO: 31. In an embodiment, the epitope consists of all twelve amino acid residues at positions 1-12 of SEQ ID NO: 31. In a particular embodiment, the epitope consists of a threonine at position 4 of SEQ ID NO: 31. In a particular embodiment, the epitope consists of a threonine at position 4 of SEQ ID NO: 22. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody binds threonine at position four if it shows reduced binding to CCR8 comprising a T4R mutation. In particular embodiments, an anti-CCR8 antibody binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556.

The present invention provides a method of treating cancer in a patient comprising administering an effective amount of an anti-CCR8 antibody, wherein the anti-CCR8 antibody does not block ligand binding to CCR8 and wherein the anti-CCR8 antibody has ADCC. In an embodiment, the anti-CCR8 antibody further has an acceptable PK. In an embodiment, the anti-CCR8 antibody binds an epitope wherein the epitope comprises at least one residue of SEQ ID NO: 82. In an embodiment, the epitope comprises at least two residues of SEQ ID NO: 82. In an embodiment, the epitope comprises at least three residues of SEQ ID NO: 82. In an embodiment, the epitope comprises at least four residues of SEQ ID NO: 82. In an embodiment, the epitope comprises at least five residues of SEQ ID NO: 82. In an embodiment, the epitope comprises six or more residues of SEQ ID NO: 82. In an embodiment, the epitope comprises seven or more residues of SEQ ID NO: 82. In an embodiment, the epitope comprises eight or more residues of SEQ ID NO: 82. In an embodiment, the epitope comprises nine or more residues of SEQ ID NO: 82. In an embodiment, the epitope comprises ten or more residues of SEQ ID NO: 82. In an embodiment, the epitope comprises eleven or more residues of SEQ ID NO: 82. In an embodiment, the epitope comprises all twelve amino acid residues of SEQ ID NO: 82. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In a particular embodiment, the epitope comprises a threonine at position 4 of SEQ ID NO: 82. In a particular embodiment, the epitope comprises a threonine at position 4 of SEQ ID NO: 22. In some embodiments, the epitope is determined by anti-CCR8 antibody binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody binds threonine at position four if it shows reduced binding to CCR8 comprising a T4R mutation. In particular embodiments, an anti-CCR8 antibody binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556.

The present invention provides a method of treating cancer in a patient comprising administering an effective amount of an anti-CCR8 antibody, wherein the anti-CCR8 antibody does not block ligand binding to CCR8 and wherein the anti-CCR8 antibody has ADCC. In an embodiment, the anti-CCR8 antibody further has an acceptable PK. In an embodiment, the anti-CCR8 antibody binds an epitope wherein the epitope consists of at least one residue of SEQ ID NO: 82. In an embodiment, the epitope consists of at least two residues of SEQ ID NO: 82. In an embodiment, the epitope consists of at least three residues of SEQ ID NO: 82. In an embodiment, the epitope consists of at least four residues of SEQ ID NO: 82. In an embodiment, the epitope consists of rises at least five residues of SEQ ID NO: 82. In an embodiment, the epitope consists of six or more residues of SEQ ID NO: 82. In an embodiment, the epitope consists of seven or more residues of SEQ ID NO: 82. In an embodiment, the epitope consists of eight or more residues of SEQ ID NO: 82. In an embodiment, the epitope consists of nine or more residues of SEQ ID NO: 82. In an embodiment, the epitope consists of ten or more residues of SEQ ID NO: 82. In an embodiment, the epitope consists of eleven or more residues of SEQ ID NO: 82. In an embodiment, the epitope consists of all twelve amino acid residues of SEQ ID NO: 82. In a particular embodiment, the epitope consists of a threonine at position 4 of SEQ ID NO: 82. In a particular embodiment, the epitope consists of a threonine at position 4 of SEQ ID NO: 22. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody binds threonine at position four if it shows reduced binding to CCR8 comprising a T4R mutation. In particular embodiments, an anti-CCR8 antibody binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556.

The present invention also provides a method of treating cancer in a patient comprising administering an effective amount of an anti-CCR8 antibody or antigen-binding fragment of the present invention to the patient. In an embodiment, the cancer is a solid tumor. In a more particular embodiment, the cancer is non-small cell lung cancer, gastric cancer, head and neck squamous cell carcinoma, hepatocellular carcinoma, triple-negative breast cancer, colorectal cancer, pancreatic cancer, or metastatic castrate-resistant prostate cancer. In an embodiment, the cancer is non-small cell lung cancer, gastric cancer, head and neck squamous cell carcinoma, hepatocellular carcinoma, or triple-negative breast cancer. In an embodiment, the cancer is non-small cell lung cancer. In an embodiment, the cancer is colorectal cancer. In an embodiment, the cancer is head and neck squamous cell carcinoma. In some embodiments, the method further comprises administering to the patient a PD-1 antagonist antibody or a PD-L1 antagonist antibody. In some such embodiments, the PD-1 antagonist antibody or PD-L1 antagonist antibody is administered prior to, concurrently with, and/or after administration of the anti-CCR8 antibody or antigen-binding fragment. In particular embodiments, the PD-1 antagonist antibody is pembrolizumab, nivolumab, cemiplimab, or zeluvalimab. In other particular embodiments, the PD-L1 antagonist antibody is atezolizumab, avelumab, or durvalumab. In an embodiment, the antibody or antigen-binding fragment thereof, is an antibody.

In some embodiments, the method further comprises administering to the patient a chemotherapeutic agent. In some embodiments, the method comprises administering to the patient an anti-CCR8 antibody or antigen-binding fragment of the present invention and a chemotherapeutic agent. In some such embodiments, the chemotherapeutic agent may be administered prior to, concurrently with, or after administration of the anti-CCR8 antibody or antigen-binding fragment of the present invention. In some embodiments, the method comprises administering to the patient an anti-CCR8 antibody of the present invention, a PD-1 or PD-L1 antagonist antibody, and a chemotherapeutic agent. In an embodiment, the antibody or antigen-binding fragment thereof, is an antibody.

The present invention provides a method of treating cancer in a patient comprising administering to the patient an effective amount of a Treg depleting antibody, a bispecific T-cell engager molecule, an agonist of a T cell co-stimulatory receptor, and/or an antagonist of the PD-1/PD-L1 pathway. In some embodiments, the patient is administered two of a Treg depleting antibody, a bispecific T-cell engager molecule, an agonist of a T cell co-stimulatory receptor, and an antagonist of the PD-1/PD-L1 pathway. In some embodiments, the patient is administered three of a Treg depleting antibody, a bispecific T-cell engager molecule, an agonist of a T cell co-stimulatory receptor, and an antagonist of the PD-1/PD-L1 pathway. In some embodiments, the patient is administered each of a Treg depleting antibody, a bispecific T-cell engager molecule, an agonist of a T cell co-stimulatory receptor, and an antagonist of the PD-1/PD-L1 pathway. In some embodiments, the patient is administered a bispecific T-cell engager molecule, an agonist of a T cell co-stimulatory receptor, and an antagonist of the PD-1/PD-L1 pathway.

The present invention also provides a method of treating cancer in a patient comprising administering to the patient an effective amount of a Treg depleting antibody and one or more of a bispecific T-cell engager molecule, an agonist of a T cell co-stimulatory receptor, and an antagonist of the PD-1/PD-L1 pathway. In an embodiment, the method comprises administering to the patient an effective amount of a Treg depleting antibody and a bispecific T-cell engager molecule. In an embodiment, the method comprises administering to the patient an effective amount of a Treg depleting antibody and an antagonist of the PD-1/PD-L1 pathway. In an embodiment, the method comprises administering to the patient an effective amount of a Treg depleting antibody and an agonist of a T cell co-stimulatory receptor. In an embodiment, the method comprises administering to the patient an effective amount of a Treg depleting antibody, a bispecific T-cell engager molecule, and an antagonist of the PD-1/PD-L1 pathway. In an embodiment, the method comprises administering to the patient an effective amount of a Treg depleting antibody, a bispecific T-cell engager molecule, an antagonist of the PD-1/PD-L1 pathway, and an agonist of a T cell co-stimulatory receptor.

In some embodiments, the Treg depleting antibody is an anti-CCR8 antibody. In some embodiments, the Treg depleting antibody is an anti-CTLA4 antibody. In an embodiment, the method comprises administering to the patient an effective amount of an anti-CCR8 antibody and a bispecific T-cell engager molecule. In an embodiment, the method comprises administering to the patient an effective amount of an anti-CCR8 antibody of the present invention and a bispecific T-cell engager molecule. In an embodiment, the method comprises administering to the patient an effective amount of an anti-CTLA-4 antibody and a bispecific T-cell engager molecule. In an embodiment, the method comprises administering to the patient an effective amount of an anti-CCR8 antibody and an antagonist of the PD-1/PD-L1 pathway. In an embodiment, the method comprises administering to the patient an effective amount of an anti-CCR8 antibody of the present invention and an antagonist of the PD-1/PD-L1 pathway. In some such embodiments, the antagonist of the PD-1/PD-L1 pathway is an PD-1 antagonist antibody. Antibody 20C1.006 (comprising LCDR1, LCDR2, LCDR3, HCDR1, HCDR2, HCDR3 amino acid sequences of SEQ ID NOs 72-77, respectively; VL and VH amino acid sequences of SEQ ID NOs 78 and 79, respectively; and LC and HC amino acid sequences of SEQ ID NOs 80 and 81, respectively), zeluvalimab (comprising LCDR1, LCDR2, LCDR3, HCDR1, HCDR2, HCDR3 amino acid sequences of SEQ ID NOs 32-37, respectively; VL and VH amino acid sequences of SEQ ID NOs 38 and 39 respectively; LC amino acid sequence of SEQ ID NO: 40; and HC amino acid sequences of SEQ ID NOs 41 or 636), Antibody 20A2.003 (comprising LCDR1, LCDR2, LCDR3, HCDR1, HCDR2, HCDR3 amino acid sequences of SEQ ID NOs 42-47, respectively; VL and VH amino acid sequences of SEQ ID NOs 48 and 49, respectively; and LC and HC amino acid sequences of SEQ ID NOs 50 and 51, respectively), Antibody 22D4.006 (comprising LCDR1, LCDR2, LCDR3, HCDR1, HCDR2, HCDR3 amino acid sequences of SEQ ID NOs 52-57, respectively; VL and VH amino acid sequences of SEQ ID NOs 58 and 59, respectively; and LC and HC amino acid sequences of SEQ ID NOs 60 and 61, respectively), or Antibody 22D4.017 (comprising LCDR1, LCDR2, LCDR3, HCDR1, HCDR2, HCDR3 amino acid sequences of SEQ ID NOs 62-67, respectively; VL and VH amino acid sequences of SEQ ID NOs 68 and 69, respectively; and LC and HC amino acid sequences of SEQ ID NOs 70 and 71, respectively). In one embodiment, the PD-1 antagonist antibody is pembrolizumab. In another embodiment, the PD-1 antagonist antibody is nivolumab. In yet another embodiment, the PD-1 antagonist antibody is cemiplimab. In a particular embodiment, the PD-1 antagonist antibody is zeluvalimab.

In an embodiment, the method comprises administering to the patient an effective amount of an anti-CCR8 antibody, a bispecific T-cell engager molecule, and an PD-1 antagonist antibody. In an embodiment, the method comprises administering to the patient an effective amount of an anti-CCR8 antibody of the present invention, a bispecific T-cell engager molecule, and an PD-1 antagonist antibody. In an embodiment, the method comprises administering to the patient an effective amount of an anti-CTLA-4 antibody, a bispecific T-cell engager molecule, and an PD-1 antagonist antibody.

In an embodiment, the method comprises administering to the patient an effective amount of an anti-CCR8 antibody, a bispecific T-cell engager molecule, an PD-1 antagonist antibody, and an agonist of a T cell co-stimulatory receptor. In an embodiment, the method comprises administering to the patient an effective amount of an anti-CCR8 antibody of the present invention, a bispecific T-cell engager molecule, an PD-1 antagonist antibody, and an agonist of a T cell co-stimulatory receptor. In an embodiment, the method comprises administering to the patient an effective amount of an anti-CTLA-4 antibody, a bispecific T-cell engager molecule, an PD-1 antagonist antibody, and an agonist of a T cell co-stimulatory receptor.

In some embodiments, the agonist of a T cell co-stimulatory receptor is an agonist of 4-1BB.

In some embodiments, the bispecific T-cell engager molecule comprises an amino acid sequence of any one of SEQ ID NOs. 87-345 in Table 15.

In some embodiments, the Treg depleting antibody is an antibody against CTLA-4, CCR8, CD25, TIGIT, CCR4, CD27, CD28, CD39, CD40, CD73, ICOS, OX40, 4-1BB, GITR, LAYN, IL1R2, or IL21R.

In some embodiments, the Treg depleting antibody is an anti-CTLA-4 antibody.

In some embodiments, the Treg depleting antibody is an anti-CCR8 antibody. In some such embodiments, the anti-CCR8 antibody is capable of depleting Treg cells. In some embodiments, the anti-CCR8 antibody is an anti-CCR8 antibody that has ADCC activity. In some embodiments, the anti-CCR8 antibody does not block ligand binding to CCR8. In some embodiments, the anti-CCR8 antibody binds human and cynomolgus monkey CCR8 on tumor-resident Treg cells. In some embodiments, the anti-CCR8 antibody binds an epitope on CCR8 wherein the epitope comprises at least one residue at positions 1-12 of SEQ ID NO. 31. In some embodiments, the anti-CCR8 antibody binds an epitope on CCR8 wherein the epitope consists of at least one residue at positions 1-12 of SEQ ID NO. 31. In a particular embodiment, the epitope comprises a threonine at position 4 of SEQ ID NO: 22. The amino acid sequence of amino acid residues 1-12 of SEQ ID NO: 31 is SEQ ID NO: 82. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody binds threonine at position four if it shows reduced binding to CCR8 comprising a T4R mutation. In particular embodiments, an anti-CCR8 antibody binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556. In some embodiments, the anti-CCR8 antibody demonstrates an acceptable pharmacokinetic profile. In a particular embodiment, the anti-CCR8 antibody is an anti-CCR8 antibody of the present invention.

In an embodiment, the agonist of an immune cell co-stimulatory receptor is an agonist of CD2, TNFRSF4 (OX40), TNFRSF5 (CD40), TNFRSF7 (CD27), TNFRSF8 (CD30), TNFRSF9 (4-1BB), TNFRSF14 (HVEM), TNFRSF18 (GITR), TNFR2, or ICOS. In a particular embodiment, the agonist of an immune cell co-stimulatory receptor is a 4-1BB agonist antibody.

In an embodiment, the antagonist of the PD-1/PD-L1 pathway is a PD-1 antagonist antibody or a PD-L1 antagonist antibody as described herein. In some embodiments, the PD-1 antagonist antibody is any one of Antibody 20C1.006, zeluvalimab, Antibody 20A2.003, Antibody 22D4.006, or Antibody 22D4.017. In one embodiment, the PD-1 antagonist antibody is pembrolizumab. In another embodiment, the PD-1 antagonist antibody is nivolumab. In yet another embodiment, the PD-1 antagonist antibody is cemiplimab. In a particular embodiment, the PD-1 antagonist antibody is zeluvalimab.

In an embodiment, the Treg depleting antibody is administered at the same time as the bispecific T-cell engager molecule, agonist of an immune cell co-stimulatory receptor, and/or an antagonist of the PD-1/PD-L1 pathway. In an embodiment, the Treg depleting antibody, bispecific T-cell engager molecule, agonist of an immune cell co-stimulatory receptor, and/or an antagonist of the PD-1/PD-L1 pathway are administered at different times. In a particular embodiment, the patient is administered a Treg depleting antibody, a bispecific T-cell engager molecule, an agonist of an immune cell co-stimulatory receptor, and an antagonist of the PD-1/PD-L1 pathway. In another particular embodiment, the patient is administered an anti-CCR8 antibody, a bispecific T-cell engager molecule, a 4-1BB agonist antibody, and an antagonist of the PD-1/PD-L1 pathway. In a particular embodiment, the anti-CCR8 antibody is an anti-CCR8 antibody of the present invention.

In an embodiment, the cancer is a solid tumor. In a more particular embodiment, the cancer is non-small cell lung cancer, gastric cancer, head and neck squamous cell carcinoma, hepatocellular carcinoma, triple-negative breast cancer, colorectal cancer, pancreatic cancer, or metastatic castrate-resistant prostate cancer. In an embodiment, the cancer is non-small cell lung cancer, gastric cancer, head and neck squamous cell carcinoma, hepatocellular carcinoma, or triple-negative breast cancer. In an embodiment, the cancer is non-small cell lung cancer. In an embodiment, the cancer is colorectal cancer. In an embodiment, the cancer is head and neck squamous cell carcinoma.

The present invention provides an anti-CCR8 antibody or antigen-binding fragment of the present invention for use in therapy. The present invention also provides an anti-CCR8 antibody or antigen-binding fragment of the present invention for use in treating cancer. In an embodiment, the cancer is a solid tumor. In an embodiment, the cancer is non-small cell lung cancer, gastric cancer, head and neck squamous cell carcinoma, hepatocellular carcinoma, triple-negative breast cancer, colorectal cancer, pancreatic cancer, or metastatic castrate-resistant prostate cancer. In a more particular embodiment, the cancer is non-small cell lung cancer, gastric cancer, head and neck squamous cell carcinoma, hepatocellular carcinoma, or triple-negative breast cancer. In some embodiments, the use further comprises administering to the patient a PD-1 antagonist antibody or a PD-L1 antagonist antibody. In some such embodiments, the PD-1 antagonist antibody or PD-L1 antagonist antibody is administered prior to, concurrently with, and/or after administration of the anti-CCR8 antibody or antigen-binding fragment. In particular embodiments, the PD-1 antagonist antibody is pembrolizumab, nivolumab, cemiplimab, or zeluvalimab. In other particular embodiments, the PD-L1 antagonist antibody is atezolizumab, avelumab, or durvalumab. In some embodiments, the use further comprises administering to the patient a chemotherapeutic agent. In some such embodiments, the chemotherapeutic agent may be administered prior to, concurrently with, or after administration of the anti-CCR8 antibody or antigen-binding fragment. In some embodiments, the use comprises administering to the patient an anti-CCR8 antibody or antigen-binding fragment of the present invention and a chemotherapeutic agent. In some embodiments, the use comprises administering to the patient an anti-CCR8 antibody or antigen-binding fragment of the present invention, a PD-1 or PD-L1 antagonist antibody, and a chemotherapeutic agent. In an embodiment, the anti-CCR8 antibody or antigen-binding fragment thereof, is an antibody.

The present invention provides an anti-CCR8 antibody or antigen-binding fragment of the present invention for the manufacture of a medicament for the treatment of cancer. In an embodiment, the cancer is a solid tumor. In an embodiment, the cancer is non-small cell lung cancer, gastric cancer, head and neck squamous cell carcinoma, hepatocellular carcinoma, triple-negative breast cancer, colorectal cancer, pancreatic cancer, or metastatic castrate-resistant prostate cancer. In a more particular embodiment, the cancer is non-small cell lung cancer, gastric cancer, head and neck squamous cell carcinoma, hepatocellular carcinoma, or triple-negative breast cancer. In an embodiment, the antibody or antigen-binding fragment thereof, is an antibody.

The present invention also provides a pharmaceutical composition comprising an anti-CCR8 antibody of the present invention, or an antigen-binding fragment thereof, and one or more pharmaceutically acceptable carriers, diluents, or excipients. In an embodiment, the antibody or antigen-binding fragment thereof, is an antibody.

In an embodiment, the anti-CCR8 antibody of the present invention comprises a HC encoded by a polynucleotide sequence comprising SEQ ID NO: 594 and a LC encoded by a polynucleotide sequence comprising SEQ ID NO: 595. In a particular embodiment, the HC comprises an amino acid sequence of SEQ ID NO: 354, and the LC comprises an amino acid sequence of SEQ ID NO: 355. In another particular embodiment, the HC comprises an amino acid sequence of SEQ ID NO: 573, and the LC comprises an amino acid sequence of SEQ ID NO: 355.

In an embodiment, the antibody of the present invention comprises a HC encoded by a polynucleotide sequence comprising SEQ ID NO: 596 and a LC encoded by a polynucleotide sequence comprising SEQ ID NO: 597. In a particular embodiment, the HC comprises an amino acid sequence of SEQ ID NO: 364, and the LC comprises an amino acid sequence of SEQ ID NO: 365. In another particular embodiment, the HC comprises an amino acid sequence of SEQ ID NO: 574, and the LC comprises an amino acid sequence of SEQ ID NO: 365.

In an embodiment, the antibody of the present invention comprises a HC encoded by a polynucleotide sequence comprising SEQ ID NO: 598 and a LC encoded by a polynucleotide sequence comprising SEQ ID NO: 599. In a particular embodiment, the HC comprises an amino acid sequence of SEQ ID NO: 374, and the LC comprises an amino acid sequence of SEQ ID NO: 375. In another particular embodiment, the HC comprises an amino acid sequence of SEQ ID NO: 575, and the LC comprises an amino acid sequence of SEQ ID NO: 375.

In an embodiment, the antibody of the present invention comprises a HC encoded by a polynucleotide sequence comprising SEQ ID NO: 600 and a LC encoded by a polynucleotide sequence comprising SEQ ID NO: 601. In a particular embodiment, the HC comprises an amino acid sequence of SEQ ID NO: 384, and the LC comprises an amino acid sequence of SEQ ID NO: 385. In another particular embodiment, the HC comprises an amino acid sequence of SEQ ID NO: 576, and the LC comprises an amino acid sequence of SEQ ID NO: 385.

In an embodiment, the antibody of the present invention comprises a HC encoded by a polynucleotide sequence comprising SEQ ID NO: 602 and a LC encoded by a polynucleotide sequence comprising SEQ ID NO: 603. In a particular embodiment, the HC comprises an amino acid sequence of SEQ ID NO: 394, and the LC comprises an amino acid sequence of SEQ ID NO: 395. In another particular embodiment, the HC comprises an amino acid sequence of SEQ ID NO: 577, and the LC comprises an amino acid sequence of SEQ ID NO: 395.

In an embodiment, the antibody of the present invention comprises a HC encoded by a polynucleotide sequence comprising SEQ ID NO: 604 and a LC encoded by a polynucleotide sequence comprising SEQ ID NO: 605. In a particular embodiment, the HC comprises an amino acid sequence of SEQ ID NO: 404, and the LC comprises an amino acid sequence of SEQ ID NO: 405. In another particular embodiment, the HC comprises an amino acid sequence of SEQ ID NO: 578, and the LC comprises an amino acid sequence of SEQ ID NO: 405.

In an embodiment, the antibody of the present invention comprises a HC encoded by a polynucleotide sequence comprising SEQ ID NO: 606 and a LC encoded by a polynucleotide sequence comprising SEQ ID NO: 607. In a particular embodiment, the HC comprises an amino acid sequence of SEQ ID NO: 414, and the LC comprises an amino acid sequence of SEQ ID NO: 415. In another particular embodiment, the HC comprises an amino acid sequence of SEQ ID NO: 579, and the LC comprises an amino acid sequence of SEQ ID NO: 415.

In an embodiment, the antibody of the present invention comprises a HC encoded by a polynucleotide sequence comprising SEQ ID NO: 608 and a LC encoded by a polynucleotide sequence comprising SEQ ID NO: 609. In a particular embodiment, the HC comprises an amino acid sequence of SEQ ID NO: 424, and the LC comprises an amino acid sequence of SEQ ID NO: 425. In another particular embodiment, the HC comprises an amino acid sequence of SEQ ID NO: 580, and the LC comprises an amino acid sequence of SEQ ID NO: 425.

In an embodiment, the antibody of the present invention comprises a HC encoded by a polynucleotide sequence comprising SEQ ID NO: 610 and a LC encoded by a polynucleotide sequence comprising SEQ ID NO: 611. In a particular embodiment, the HC comprises an amino acid sequence of SEQ ID NO: 434, and the LC comprises an amino acid sequence of SEQ ID NO: 435. In another particular embodiment, the HC comprises an amino acid sequence of SEQ ID NO: 581, and the LC comprises an amino acid sequence of SEQ ID NO: 435.

In an embodiment, the antibody of the present invention comprises a HC encoded by a polynucleotide sequence comprising SEQ ID NO: 612 and a LC encoded by a polynucleotide sequence comprising SEQ ID NO: 613. In a particular embodiment, the HC comprises an amino acid sequence of SEQ ID NO: 444, and the LC comprises an amino acid sequence of SEQ ID NO: 445. In another particular embodiment, the HC comprises an amino acid sequence of SEQ ID NO: 582, and the LC comprises an amino acid sequence of SEQ ID NO: 445.

In an embodiment, the antibody of the present invention comprises a HC encoded by a polynucleotide sequence comprising SEQ ID NO: 614 and a LC encoded by a polynucleotide sequence comprising SEQ ID NO: 615. In a particular embodiment, the HC comprises an amino acid sequence of SEQ ID NO: 454, and the LC comprises an amino acid sequence of SEQ ID NO: 455. In another particular embodiment, the HC comprises an amino acid sequence of SEQ ID NO: 583, and the LC comprises an amino acid sequence of SEQ ID NO: 455.

In an embodiment, the antibody of the present invention comprises a HC encoded by a polynucleotide sequence comprising SEQ ID NO: 616 and a LC encoded by a polynucleotide sequence comprising SEQ ID NO: 617. In a particular embodiment, the HC comprises an amino acid sequence of SEQ ID NO: 464, and the LC comprises an amino acid sequence of SEQ ID NO: 465. In another particular embodiment, the HC comprises an amino acid sequence of SEQ ID NO: 584, and the LC comprises an amino acid sequence of SEQ ID NO: 465.

In an embodiment, the antibody of the present invention comprises a HC encoded by a polynucleotide sequence comprising SEQ ID NO: 618 and a LC encoded by a polynucleotide sequence comprising SEQ ID NO: 619. In a particular embodiment, the HC comprises an amino acid sequence of SEQ ID NO: 474, and the LC comprises an amino acid sequence of SEQ ID NO: 475. In another particular embodiment, the HC comprises an amino acid sequence of SEQ ID NO: 585, and the LC comprises an amino acid sequence of SEQ ID NO: 475.

In an embodiment, the antibody of the present invention comprises a HC encoded by a polynucleotide sequence comprising SEQ ID NO: 620 and a LC encoded by a polynucleotide sequence comprising SEQ ID NO: 621. In a particular embodiment, the HC comprises an amino acid sequence of SEQ ID NO: 484, and the LC comprises an amino acid sequence of SEQ ID NO: 485. In another particular embodiment, the HC comprises an amino acid sequence of SEQ ID NO: 586, and the LC comprises an amino acid sequence of SEQ ID NO: 485.

In an embodiment, the antibody of the present invention comprises a HC encoded by a polynucleotide sequence comprising SEQ ID NO: 622 and a LC encoded by a polynucleotide sequence comprising SEQ ID NO: 623. In a particular embodiment, the HC comprises an amino acid sequence of SEQ ID NO: 494, and the LC comprises an amino acid sequence of SEQ ID NO: 495. In another particular embodiment, the HC comprises an amino acid sequence of SEQ ID NO: 587, and the LC comprises an amino acid sequence of SEQ ID NO: 495.

In an embodiment, the antibody of the present invention comprises a HC encoded by a polynucleotide sequence comprising SEQ ID NO: 624 and a LC encoded by a polynucleotide sequence comprising SEQ ID NO: 625. In a particular embodiment, the HC comprises an amino acid sequence of SEQ ID NO: 504, and the LC comprises an amino acid sequence of SEQ ID NO: 505. In another particular embodiment, the HC comprises an amino acid sequence of SEQ ID NO: 588, and the LC comprises an amino acid sequence of SEQ ID NO: 505.

In an embodiment, the antibody of the present invention comprises a HC encoded by a polynucleotide sequence comprising SEQ ID NO: 626 and a LC encoded by a polynucleotide sequence comprising SEQ ID NO: 627. In a particular embodiment, the HC comprises an amino acid sequence of SEQ ID NO: 514, and the LC comprises an amino acid sequence of SEQ ID NO: 515. In another particular embodiment, the HC comprises an amino acid sequence of SEQ ID NO: 589, and the LC comprises an amino acid sequence of SEQ ID NO: 515.

In an embodiment, the antibody of the present invention comprises a HC encoded by a polynucleotide sequence comprising SEQ ID NO: 628 and a LC encoded by a polynucleotide sequence comprising SEQ ID NO: 629. In a particular embodiment, the HC comprises an amino acid sequence of SEQ ID NO: 524, and the LC comprises an amino acid sequence of SEQ ID NO: 525. In another particular embodiment, the HC comprises an amino acid sequence of SEQ ID NO: 590, and the LC comprises an amino acid sequence of SEQ ID NO: 525.

In an embodiment, the antibody of the present invention comprises a HC encoded by a polynucleotide sequence comprising SEQ ID NO: 630 and a LC encoded by a polynucleotide sequence comprising SEQ ID NO: 631. In a particular embodiment, the HC comprises an amino acid sequence of SEQ ID NO: 534, and the LC comprises an amino acid sequence of SEQ ID NO: 535. In another particular embodiment, the HC comprises an amino acid sequence of SEQ ID NO: 591, and the LC comprises an amino acid sequence of SEQ ID NO: 535.

In an embodiment, the antibody of the present invention comprises a HC encoded by a polynucleotide sequence comprising SEQ ID NO: 632 and a LC encoded by a polynucleotide sequence comprising SEQ ID NO: 633. In a particular embodiment, the HC comprises an amino acid sequence of SEQ ID NO: 544, and the LC comprises an amino acid sequence of SEQ ID NO: 545. In another particular embodiment, the HC comprises an amino acid sequence of SEQ ID NO: 592, and the LC comprises an amino acid sequence of SEQ ID NO: 545.

In an embodiment, the antibody of the present invention comprises a HC encoded by a polynucleotide sequence comprising SEQ ID NO: 634 and a LC encoded by a polynucleotide sequence comprising SEQ ID NO: 635. In a particular embodiment, the HC comprises an amino acid sequence of SEQ ID NO: 554, and the LC comprises an amino acid sequence of SEQ ID NO: 555. In another particular embodiment, the HC comprises an amino acid sequence of SEQ ID NO: 593, and the LC comprises an amino acid sequence of SEQ ID NO: 555.

Also provided herein are one or more nucleic acid sequences encoding the anti-CCR8 antibody or antigen-binding fragment of the present invention. In some embodiments, the present invention provides a DNA molecule comprising a polynucleotide that encodes a HC of an antibody of the present invention. The present invention also provides a DNA molecule comprising a polynucleotide that encodes a LC of an antibody of the present invention. The present invention also provides a DNA molecule comprising a polynucleotide that encodes both a LC of an antibody of the present invention and a HC of an antibody of the present invention. In some embodiments, the invention provides a nucleic acid sequence encoding a heavy chain amino acid sequence of SEQ ID NOs: 1127, 1129, 1131, 1134, 1136, 1138, 1140, 1142, 1144, 1146, 1148, 1150, 1152, 1154, 1156, 1158, or 1160. In other embodiments, the invention provides a nucleic acid sequence encoding a light chain amino acid sequence of SEQ ID NOs: 1128, 1130, 1132, 1133, 1135, 1137, 1139, 1141, 1143, 1145, 1147, 1149, 1151, 1153, 1155, 1157, or 1159.

The present invention also provides a DNA molecule comprising a polynucleotide that encodes an antibody LC wherein the LC has an amino acid sequence of SEQ ID NO: 16. In an embodiment, the polynucleotide comprises a polynucleotide sequence of SEQ ID NO: 28. The present invention also provides DNA molecules where one DNA molecule comprises a polynucleotide that encodes an antibody HC wherein the HC has an amino acid sequence of SEQ ID NO: 15, and another DNA molecule comprises a polynucleotide that encodes a LC wherein the LC has an amino acid sequence of SEQ ID NO: 16. In an embodiment, the polynucleotide that encodes the antibody HC comprises a polynucleotide sequence of SEQ ID NO: 27, and the polynucleotide that encodes the LC comprises a polynucleotide sequence of SEQ ID NO: 28.

The present invention further provides a mammalian cell transformed with a DNA molecule of the present invention, wherein the transformed mammalian cell is capable of expressing an antibody of the present invention, wherein the antibody comprises two HCs and two LCs.

The present invention further provides a mammalian cell transformed with a DNA molecule of the present invention, wherein the transformed mammalian cell is capable of expressing an antibody comprising two HCs and two LCs, wherein each HC comprises an amino acid sequence of SEQ ID NO: 15, and each LC comprises an amino acid sequence of SEQ ID NO: 16.

The present invention also provides a process for producing an antibody of the present invention, wherein the antibody comprises two HCs and two LCs, and wherein the process comprises cultivating a mammalian cell under conditions such that the antibody is expressed and recovering the expressed antibody. In an embodiment, the mammalian cell is transformed with a DNA molecule of the present invention, wherein the transformed mammalian cell is capable of expressing an antibody of the present invention comprising two HCs and two LCs. The present invention also provides an antibody obtainable by the process.

The present invention also provides a process for producing an antibody, wherein the antibody comprises two HCs and two LCs, each HC comprises an amino acid sequence of SEQ ID NO: 15 and each LC comprises an amino acid sequence of SEQ ID NO: 16. In an embodiment, the process comprises cultivating a mammalian cell under conditions such that the antibody is expressed and recovering the expressed antibody, and wherein the mammalian cell is transformed with a DNA molecule of the present invention, wherein the transformed mammalian cell is capable of expressing an antibody comprising two HCs and two LCs, wherein each HC comprises an amino acid sequence of SEQ ID NO: 15, and each LC comprises an amino acid sequence of SEQ ID NO: 16. The present invention also provides an antibody obtainable by the process.

The present invention provides a DNA molecule comprising a polynucleotide that encodes an antibody HC, wherein the HC has an amino acid sequence of SEQ ID NO: 19. In an embodiment, the polynucleotide sequence comprises SEQ ID NO: 29.

The present invention provides a DNA molecule comprising a polynucleotide that encodes an antibody LC wherein the LC has an amino acid sequence of SEQ ID NO: 20. In an embodiment, the polynucleotide sequence comprises SEQ ID NO: 30.

The present invention provides a DNA molecule comprising a polynucleotide that encodes an antibody HC wherein the HC has an amino acid sequence of SEQ ID NO: 19. In an embodiment, the polynucleotide that encodes the antibody HC comprises a polynucleotide sequence of SEQ ID NO: 29. The present invention also provides a DNA molecule comprising a polynucleotide that encodes an antibody LC wherein the LC has an amino acid sequence of SEQ ID NO: 20. In an embodiment, the polynucleotide that encodes the LC comprises a polynucleotide sequence of SEQ ID NO: 30. The present invention also provides a mammalian cell transformed with a DNA molecule of the present invention, wherein the transformed mammalian cell is capable of expressing an antibody comprising two HCs and two LCs, wherein each HC comprises an amino acid sequence of SEQ ID NO: 19, and each LC comprises an amino acid sequence of SEQ ID NO: 20.

In some embodiments, a nucleic acid sequence encoding an HC described herein may comprise any one of SEQ ID NOs: 1195, 1197, 1199, 1201, 1204, 1206, 1208, 1210, 1212, 1214, 1216, 1218, 1220, 1222, 1224, 1226, 1228, or 1230.

In some embodiments, a nucleic acid sequence encoding an LC described herein may comprise any one of SEQ ID NOs: 1196, 1198, 1200, 1202, 1203, 1205, 1207, 1209, 1211, 1213, 1215, 1217, 1219, 1221, 1223, 1225, 1227, or 1229.

In some embodiments, a nucleic acid sequence encoding an scFv described herein may comprise any one of SEQ ID NOs: 1163-1194.

The present invention also provides a process for producing an antibody, wherein the antibody comprises two HCs and two LCs, each HC comprises an amino acid sequence of SEQ ID NO: 19 and each LC comprises an amino acid sequence of SEQ ID NO: 20. In an embodiment, the process comprises cultivating a mammalian cell under conditions such that the antibody is expressed and recovering the expressed antibody, and wherein the mammalian cell is transformed with a DNA molecule of the present invention. In an embodiment, the transformed mammalian cell is capable of expressing an antibody comprising two HCs and two LCs, wherein each HC comprises an amino acid sequence of SEQ ID NO: 19, and each LC comprises an amino acid sequence of SEQ ID NO: 20. The present invention also provides an antibody obtainable by the process.

The present invention also provides a process for producing an antibody comprising two HCs and two LCs, wherein the process comprises cultivating the above-described mammalian cell under conditions such that the antibody is expressed and recovering the expressed antibody, wherein: (a) both HCs comprise an amino acid sequence of SEQ ID NOs: 15, 1125, 1127, 1129, 1131, 1134, 1136, 1138, 1140, 1142, 1144, 1146, 1148, 1150, 1152, 1154, 1156, 1158, or 1160, or an amino acid sequence that is at least 90% identical to any one of the foregoing HC amino acid sequences; and (b) both LCs comprise an amino acid sequence of SEQ ID NOs: 16, 365, 1126, 1128, 1130, 1132, 1133, 1135, 1137, 1139, 1141, 1143, 1145, 1147, 1149, 1151, 1153, 1155, 1157, or 1159, or an amino acid sequence that is at least 90% identical to any one of the foregoing LC amino acid sequences.

In another embodiment, the present invention provides an antibody or antigen-binding fragment thereof that binds human CCR8 at an epitope wherein the epitope comprises at least one residue at positions 1-12 of SEQ ID NO: 31. In an embodiment, the epitope comprises at least two residues at positions 1-12 of SEQ ID NO: 31. In an embodiment, the epitope comprises at least three residues at positions 1-12 of SEQ ID NO: 31. In an embodiment, the epitope comprises at least four residues at positions 1-12 of SEQ ID NO: 31. In an embodiment, the epitope comprises at least five residues at positions 1-12 of SEQ ID NO: 31. In an embodiment, the epitope comprises six or more residues at positions 1-12 of SEQ ID NO: 31. In an embodiment, the epitope comprises seven or more residues at positions 1-12 of SEQ ID NO: 31. In an embodiment, the epitope comprises eight or more residues at positions 1-12 of SEQ ID NO: 31. In an embodiment, the epitope comprises nine or more residues at positions 1-12 of SEQ ID NO: 31. In an embodiment, the epitope comprises ten or more residues at positions 1-12 of SEQ ID NO: 31. In an embodiment, the epitope comprises eleven or more residues at positions 1-12 of SEQ ID NO: 31. In an embodiment, the epitope comprises all twelve amino acid residues at positions 1-12 of SEQ ID NO: 31. In a particular embodiment, the epitope comprises a threonine at position 4 of SEQ ID NO: 31. The amino acid sequence of amino acid residues 1-12 of SEQ ID NO: 31 is SEQ ID NO: 82. In a particular embodiment, the epitope comprises a threonine at position 4 of SEQ ID NO: 22. In some such embodiments, the anti-CCR8 antibody does not block the binding of CCL1 to CCR8. In an embodiment, the epitope is determined by epitope binning. In an embodiment, the epitope is determined by antibody binding to CCR8 peptide-nanobody complexes. In an embodiment, the epitope is determined by determining binding to a CCR8 peptide expressed in human cells, wherein the peptide comprises an amino acid sequence given by SEQ ID NO: 82. In an embodiment, the epitope is determined by screening antibody binding to CCR8 by phage display. In another embodiment, the present invention provides an antibody or antigen-binding fragment thereof that binds human CCR8 at an epitope wherein the epitope consists of at least one residue at positions 1-12 of SEQ ID NO: 31. In an embodiment, the epitope consists of at least two residues at positions 1-12 of SEQ ID NO: 31. In an embodiment, the epitope consists of at least three residues at positions 1-12 of SEQ ID NO: 31. In an embodiment, the epitope consists of at least four residues at positions 1-12 of SEQ ID NO: 31. In an embodiment, the epitope consists of at least five residues at positions 1-12 of SEQ ID NO: 31. In an embodiment, the epitope consists of six or more residues at positions 1-12 of SEQ ID NO: 31. In an embodiment, the epitope consists of seven or more residues at positions 1-12 of SEQ ID NO: 31. In an embodiment, the epitope consists of eight or more residues at positions 1-12 of SEQ ID NO: 31. In an embodiment, the epitope consists of nine or more residues at positions 1-12 of SEQ ID NO: 31. In an embodiment, the epitope consists of ten or more residues at positions 1-12 of SEQ ID NO: 31. In an embodiment, the epitope consists of eleven or more residues at positions 1-12 of SEQ ID NO: 31. In an embodiment, the epitope consists of all twelve amino acid residues at positions 1-12 of SEQ ID NO: 31. In a particular embodiment, the epitope consists of a threonine at position 4 of SEQ ID NO: 31. The amino acid sequence of amino acid residues 1-12 of SEQ ID NO: 31 is SEQ ID NO: 82. In a particular embodiment, the epitope consists of a threonine at position 4 of SEQ ID NO: 22. In some such embodiments, the anti-CCR8 antibody does not block the binding of CCL1 to CCR8. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody or antigen-binding fragment thereof binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody or antigen-binding fragment thereof binds threonine at position four if it shows reduced binding to CCR8 comprising a T4R mutation. In particular embodiments, an anti-CCR8 antibody or antigen-binding fragment thereof binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556. In an embodiment, the anti-CCR8 antibody or fragment thereof is an antibody.

In another embodiment, the present invention provides an antibody or antigen-binding fragment thereof that binds human CCR8 at an epitope wherein the epitope comprises at least one residue of SEQ ID NO: 82. In an embodiment, the epitope comprises at least two residues of SEQ ID NO: 82. In an embodiment, the epitope comprises at least three residues of SEQ ID NO: 82. In an embodiment, the epitope comprises at least four residues of SEQ ID NO: 82. In an embodiment, the epitope comprises at least five residues of SEQ ID NO: 82. In an embodiment, the epitope comprises six or more residues of SEQ ID NO: 82. In an embodiment, the epitope comprises seven or more residues of SEQ ID NO: 82. In an embodiment, the epitope comprises eight or more residues of SEQ ID NO: 82. In an embodiment, the epitope comprises nine or more residues of SEQ ID NO: 82. In an embodiment, the epitope comprises ten or more residues of SEQ ID NO: 82. In an embodiment, the epitope comprises eleven or more residues of SEQ ID NO: 82. In an embodiment, the epitope comprises all twelve amino acid residues of SEQ ID NO: 82. In a particular embodiment, the epitope comprises a threonine at position 4 of SEQ ID NO: 82. In a particular embodiment, the epitope comprises a threonine at position 4 of SEQ ID NO: 22. In some such embodiments, the anti-CCR8 antibody does not block the binding of CCL1 to CCR8. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody or antigen-binding fragment thereof binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody or antigen-binding fragment thereof binds threonine at position four if it shows reduced binding to CCR8 comprising a T4R mutation. In particular embodiments, an anti-CCR8 antibody or antigen-binding fragment thereof binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556. In an embodiment, the anti-CCR8 antibody or fragment thereof is an antibody.

In another embodiment, the present invention provides an antibody or antigen-binding fragment thereof that binds human CCR8 at an epitope wherein the epitope consists of at least one residue of SEQ ID NO: 82. In an embodiment, the epitope consists of at least two residues of SEQ ID NO: 82. In an embodiment, the epitope consists of at least three residues of SEQ ID NO: 82. In an embodiment, the epitope consists of at least four residues of SEQ ID NO: 82. In an embodiment, the epitope consists of at least five residues of SEQ ID NO: 82. In an embodiment, the epitope consists of six or more residues of SEQ ID NO: 82. In an embodiment, the epitope consists of seven or more residues of SEQ ID NO: 82. In an embodiment, the epitope consists of eight or more residues of SEQ ID NO: 82. In an embodiment, the epitope consists of nine or more residues of SEQ ID NO: 82. In an embodiment, the epitope consists of ten or more residues of SEQ ID NO: 82. In an embodiment, the epitope consists of eleven or more residues of SEQ ID NO: 82. In an embodiment, the epitope consists of all twelve amino acid residues of SEQ ID NO: 82. In a particular embodiment, the epitope consists of a threonine at position 4 of SEQ ID NO: 82. In a particular embodiment, the epitope consists of a threonine at position 4 of SEQ ID NO: 22. In some such embodiments, the anti-CCR8 antibody does not block the binding of CCL1 to CCR8. In an embodiment, the epitope is determined by epitope binning. In an embodiment, the epitope is determined by antibody binding to CCR8 peptide-nanobody complexes. In an embodiment, the epitope is determined by screening antibody binding to CCR8 by phage display. In an embodiment, the epitope is determined by determining binding to a CCR8 peptide expressed in human cells, wherein the peptide comprises an amino acid sequence given by SEQ ID NO: 82. In some embodiments, the epitope is determined by anti-CCR8 antibody or antigen-binding fragment thereof binding to the T4R mutation in cynomolgus monkey CCR8. In an embodiment, binding to the T4R mutation is determined in a cell based affinity assay, wherein antibody binding to cells expressing cynomolgus monkey CCR8 containing a T4R mutation is compared to antibody binding to cells expressing wild-type cynomolgus monkey CCR8 (comprising a threonine at position four). In some embodiments, an anti-CCR8 antibody or antigen-binding fragment thereof binds threonine at position four if it shows reduced binding to CCR8 comprising a T4R mutation. In particular embodiments, an anti-CCR8 antibody or antigen-binding fragment thereof binds threonine at position four if it shows no detectable binding to CCR8 comprising a T4R mutation. In some embodiments, wild-type cynomolgus monkey CCR8 comprises an amino acid sequence given by SEQ ID NO: 22. In some embodiments, cynomolgus monkey CCR8 comprising a T4R mutation comprises an amino acid sequence given by SEQ ID NO: 556. In an embodiment, the anti-CCR8 antibody or fragment thereof is an antibody.

In some embodiments, an anti-CCR8 antibody or fragment thereof of the present invention does not bind an epitope comprising amino acids of SEQ ID NO: 83. In some embodiments, an anti-CCR8 antibody or fragment thereof of the present invention does not bind an epitope comprising amino acids of SEQ ID NO: 86. In some embodiments, an anti-CCR8 antibody or fragment thereof of the present invention does not bind an epitope comprising amino acids of SEQ ID NO: 84. In some embodiments, the epitope is determined by antibody binding to a peptide of amino acids of SEQ ID NO: 85, SEQ ID NO: 83, SEQ ID NO: 86, and/or SEQ ID NO: 84. In some embodiments, an anti-CCR8 antibody or fragment thereof of the present invention does not bind an epitope comprising amino acids at positions 13 through 35 of SEQ ID NO: 31. In some embodiments, an anti-CCR8 antibody or fragment thereof of the present invention does not bind an epitope comprising amino acids at positions 13, 14, or 15 of SEQ ID NO: 31.

In some embodiments, an anti-CCR8 antibody or fragment thereof of the present invention does not bind an epitope consisting of amino acids of SEQ ID NO: 83. In some embodiments, an anti-CCR8 antibody or fragment thereof of the present invention does not bind an epitope consisting of amino acids of SEQ ID NO: 86. In some embodiments, an anti-CCR8 antibody or fragment thereof of the present invention does not bind an epitope consisting of amino acids of SEQ ID NO: 84. In some embodiments, the epitope is determined by antibody binding to a peptide of amino acids of SEQ ID NO: 85, SEQ ID NO: 83, SEQ ID NO: 86, and/or SEQ ID NO: 84. In some embodiments, an anti-CCR8 antibody or fragment thereof of the present invention does not bind an epitope consisting of amino acids at positions 13 through 35 of SEQ ID NO: 31. In some embodiments, an anti-CCR8 antibody or fragment thereof of the present invention does not bind an epitope consisting of amino acids at positions 13, 14, or 15 of SEQ ID NO: 31.

In some embodiments, an anti-CCR8 antibody or fragment thereof of the present invention does not bind an epitope comprising amino acids residues at position 13-24 of SEQ ID NO: 31. In some embodiments, an anti-CCR8 antibody or fragment thereof of the present invention does not bind an epitope comprising amino acids residues at position 19-30 of SEQ ID NO: 31. In some embodiments, an anti-CCR8 antibody or fragment thereof of the present invention does not bind an epitope comprising amino acids residues at position 25-35 of SEQ ID NO: 31. In some embodiments, the epitope is determined by antibody binding to a peptide of amino acids of SEQ ID NO: 85, SEQ ID NO: 83, SEQ ID NO: 86, and/or SEQ ID NO: 84.

In some embodiments, an anti-CCR8 antibody or fragment thereof of the present invention does not bind an epitope consisting of amino acids residues at position 13-24 of SEQ ID NO: 31. In some embodiments, an anti-CCR8 antibody or fragment thereof of the present invention does not bind an epitope consisting of amino acids residues at position 19-30 of SEQ ID NO: 31. In some embodiments, an anti-CCR8 antibody or fragment thereof of the present invention does not bind an epitope consisting of amino acids residues at position 25-35 of SEQ ID NO: 31. In some embodiments, the epitope is determined by antibody binding to a peptide of amino acids of SEQ ID NO: 85, SEQ ID NO: 83, SEQ ID NO: 86, and/or SEQ ID NO: 84.

The term "epitope" as used herein refers to sites of an antigen that are in contact with the variable region of an antibody. The epitope may be continuous or non-continuous, and may be determined by a method known to a person of ordinary skill, including flow cytometry of bound antibody to peptides, hydrogen-deuterium exchange, alanine scanning, and/or x-ray crystallography.

The epitope may be an epitope comprising or consisting of amino acid residues that are determined by antibody binding to a peptide as described herein. In some such embodiments, the peptide comprises an amino acid sequence of SEQ ID NO: 82. In some such embodiments, the peptide comprises an amino acid sequence of residues at positions 1-12 of SEQ ID NO: 31.

The epitope may be an epitope comprising or consisting of amino acid residues that are determined by epitope binning. In some such embodiments, the epitope binning is performed with biotinylated N-terminus CCR8 peptides.

The epitope may be an epitope comprising or consisting of amino acid residues that are determined by antibody binding to CCR8 peptide-nanobody complexes.

The epitope may be an epitope comprising or consisting of amino acid residues that are determined by screening antibody binding to CCR8 by phage display.

The epitope may be an epitope comprising or consisting of threonine at position four of the N-terminal region of CCR8 as determined by reduced binding to CCR8 comprising a T4R mutation compared to binding to wild-type CCR8. Binding to the T4R mutation may be tested, for example, by determining binding to wild-type cynomolgus monkey CCR8 (comprising an amino acid sequence given by SEQ ID NO: 22) compared to binding cynomolgus monkey CCR8 comprising a T4R mutation (comprising an amino acid sequence given by SEQ ID NO: 556).

The epitope may be an epitope comprising or consisting of amino acid residues that are determined by determining binding to a CCR8 peptide expressed in human cells, wherein the peptide comprises an amino acid sequence given by SEQ ID NO: 82. The CCR8 peptide may be fused to a nanobody, or other protein or Fc, for expression in human cells.

The present invention further provides an antibody or antigen-binding fragment that binds to an epitope on human CCR8, wherein said epitope comprises or consists of SEQ ID NO: 82. In some embodiments, the present invention also provides an antibody or antigen-binding fragment, wherein said antibody or antigen-binding fragment: (a) binds to an epitope on human CCR8, wherein said epitope comprises or consists of SEQ ID NO: 82; and (b) does not block the binding of CCL1 to CCR8. In an embodiment, the antibody or antigen-binding fragment thereof, is an antibody.

In some embodiments, the present invention provides a molecule that competes for binding to CCR8 with an anti-CCR8 antibody or antigen-binding fragment of the present invention. Such molecule that competes for binding may be, for example, an antibody, antibody fragment, or polypeptide. In some embodiments, the present invention provides a molecule that binds the same epitope as an anti-CCR8 antibody or antigen-binding fragment of the present invention. In an embodiment, the anti-CCR8 antibody or antigen-binding fragment thereof, is an antibody.

The present invention provides a method of treating cancer in a patient comprising administering to the patient an effective amount of an antibody or antigen-binding fragment that binds human CCR8 at an epitope wherein the epitope comprises at least one residue at positions 1-12 of SEQ ID NO: 31. In an embodiment, the epitope comprises at least two residues at positions 1-12 of SEQ ID NO: 31. In an embodiment, the epitope comprises at least three residues at positions 1-12 of SEQ ID NO: 31. In an embodiment, the epitope comprises at least four residues at positions 1-12 of SEQ ID NO: 31. In an embodiment, the epitope comprises at least five residues at positions 1-12 of SEQ ID NO: 31. In an embodiment, the epitope comprises six or more residues at positions 1-12 of SEQ ID NO: 31. In an embodiment, the epitope comprises seven or more residues at positions 1-12 of SEQ ID NO: 31. In an embodiment, the epitope comprises eight or more residues at positions 1-12 of SEQ ID NO: 31. In an embodiment, the epitope comprises nine or more residues at positions 1-12 of SEQ ID NO: 31. In an embodiment, the epitope comprises ten or more residues at positions 1-12 of SEQ ID NO: 31. In an embodiment, the epitope comprises eleven or more residues at positions 1-12 of SEQ ID NO: 31. In an embodiment, the epitope comprises all twelve amino acid residues at positions 1-12 of SEQ ID NO: 31. In a particular embodiment, the epitope comprises a threonine at position 4 of SEQ ID NO: 31. The amino acid sequence of amino acid residues 1-12 of SEQ ID NO: 31 is SEQ ID NO: 82. In a particular embodiment, the epitope comprises a threonine at position 4 of SEQ ID NO: 22. In some such embodiments, the anti-CCR8 antibody or antigen-binding fragment does not block the binding of CCL1 to CCR8. In an embodiment, the antibody or antigen-binding fragment thereof, is an antibody.

The present invention provides a method of treating cancer in a patient comprising administering to the patient an effective amount of an antibody or antigen-binding fragment that binds human CCR8 at an epitope wherein the epitope consists of at least one residue at positions 1-12 of SEQ ID NO: 31. In an embodiment, the epitope consists of at least two residues at positions 1-12 of SEQ ID NO: 31. In an embodiment, the epitope consists of at least three residues at positions 1-12 of SEQ ID NO: 31. In an embodiment, the epitope consists of at least four residues at positions 1-12 of SEQ ID NO: 31. In an embodiment, the epitope consists of at least five residues at positions 1-12 of SEQ ID NO: 31. In an embodiment, the epitope consists of six or more residues at positions 1-12 of SEQ ID NO: 31. In an embodiment, the epitope consists of seven or more residues at positions 1-12 of SEQ ID NO: 31. In an embodiment, the epitope consists of eight or more residues at positions 1-12 of SEQ ID NO: 31. In an embodiment, the epitope consists of nine or more residues at positions 1-12 of SEQ ID NO: 31. In an embodiment, the epitope consists of ten or more residues at positions 1-12 of SEQ ID NO: 31. In an embodiment, the epitope consists of eleven or more residues at positions 1-12 of SEQ ID NO: 31. In an embodiment, the epitope consists of all twelve amino acid residues at positions 1-12 of SEQ ID NO: 31. In a particular embodiment, the epitope consists of a threonine at position 4 of SEQ ID NO: 31. The amino acid sequence of amino acid residues 1-12 of SEQ ID NO: 31 is SEQ ID NO: 82. In a particular embodiment, the epitope consists of a threonine at position 4 of SEQ ID NO: 22. In some such embodiments, the anti-CCR8 antibody or antigen-binding fragment does not block the binding of CCL1 to CCR8. In an embodiment, the antibody or antigen-binding fragment thereof, is an antibody.

The present invention provides a method of treating cancer in a patient comprising administering to the patient an effective amount of an antibody or antigen-binding fragment that binds human CCR8 at an epitope wherein the epitope comprises at least one residue of SEQ ID NO: 82. In an embodiment, the epitope comprises at least two residues of SEQ ID NO: 82. In an embodiment, the epitope comprises at least three residues of SEQ ID NO: 82. In an embodiment, the epitope comprises at least four residues of SEQ ID NO: 82. In an embodiment, the epitope comprises at least five residues of SEQ ID NO: 82. In an embodiment, the epitope comprises six or more residues of SEQ ID NO: 82. In an embodiment, the epitope comprises seven or more residues of SEQ ID NO: 82. In an embodiment, the epitope comprises eight or more residues of SEQ ID NO: 82. In an embodiment, the epitope comprises nine or more residues of SEQ ID NO: 82. In an embodiment, the epitope comprises ten or more residues of SEQ ID NO: 82. In an embodiment, the epitope comprises eleven or more residues of SEQ ID NO: 82. In an embodiment, the epitope comprises all twelve amino acid residues of SEQ ID NO: 82. In a particular embodiment, the epitope comprises a threonine at position 4 of SEQ ID NO: 82. In a particular embodiment, the epitope comprises a threonine at position 4 of SEQ ID NO: 22. In some such embodiments, the anti-CCR8 antibody or antigen-binding fragment does not block the binding of CCL1 to CCR8. In an embodiment, the antibody or antigen-binding fragment thereof, is an antibody.

The present invention provides a method of treating cancer in a patient comprising administering to the patient an effective amount of an antibody or antigen-binding fragment that binds human CCR8 at an epitope wherein the epitope consists of at least one residue of SEQ ID NO: 82. In an embodiment, the epitope consists of at least two residues of SEQ ID NO: 82. In an embodiment, the epitope consists of at least three residues of SEQ ID NO: 82. In an embodiment, the epitope consists of at least four residues of SEQ ID NO: 82. In an embodiment, the epitope consists of at least five residues of SEQ ID NO: 82. In an embodiment, the epitope consists of six or more residues of SEQ ID NO: 82. In an embodiment, the epitope consists of seven or more residues of SEQ ID NO: 82. In an embodiment, the epitope consists of eight or more residues of SEQ ID NO: 82. In an embodiment, the epitope consists of nine or more residues of SEQ ID NO: 82. In an embodiment, the epitope consists of ten or more residues of SEQ ID NO: 82. In an embodiment, the epitope consists of eleven or more residues of SEQ ID NO: 82. In an embodiment, the epitope consists of all twelve amino acid residues of SEQ ID NO: 82. In a particular embodiment, the epitope consists of a threonine at position 4 of SEQ ID NO: 82. In a particular embodiment, the epitope consists of a threonine at position 4 of SEQ ID NO: 22. In some such embodiments, the anti-CCR8 antibody or antigen-binding fragment does not block the binding of CCL1 to CCR8. In an embodiment, the antibody or antigen-binding fragment thereof, is an antibody.

In some embodiments, the present invention provides a method of treating cancer in a patient comprising administering to the patient an effective amount of a molecule that competes for binding to CCR8 with an anti-CCR8 antibody or antigen-binding fragment of the present invention. Such molecule that competes for binding may be, for example, an antibody, antibody fragment, or polypeptide. In some embodiments, the present invention provides a molecule that binds the same epitope as an anti-CCR8 antibody of the present invention. In an embodiment, the anti-CCR8 antibody or antigen-binding fragment thereof, is an antibody.

In some embodiments, an anti-CCR8 antibody or antigen-binding fragment of the present invention binds CCR8 from a non-human species. In some embodiments, an anti-CCR8 antibody or antigen-binding fragment of the present invention binds cynomolgus monkey CCR8. In some embodiments, an anti-CCR8 antibody or antigen-binding fragment of the present invention binds murine CCR8. In some embodiments, the anti-CCR8 antibody or antigen-binding fragment of the present invention binds both cynomolgus monkey CCR8 and human CCR8. In a particular embodiment, an anti-CCR8 antibody or antigen-binding fragment of the present invention bind cynomolgus monkey CCR8 and human CCR8 with affinities that are within 10-fold of one another. In an embodiment, the antibody or antigen-binding fragment thereof, is an antibody.

BRIEF DESCRIPTION OF THE DRAWINGS

FIG. 2A demonstrates the mean tumor volume for each group through day 24. **** indicates p<0.0001.

FIGS. 4A, 4B, 4C, and 4D represent % Foxp3+ Treg, % CD25+Foxp3+ Treg, CD8/Treg (Foxp3+), and CD8/Treg (CD25+Foxp3+), respectively.

DETAILED DESCRIPTION

Figure 1:
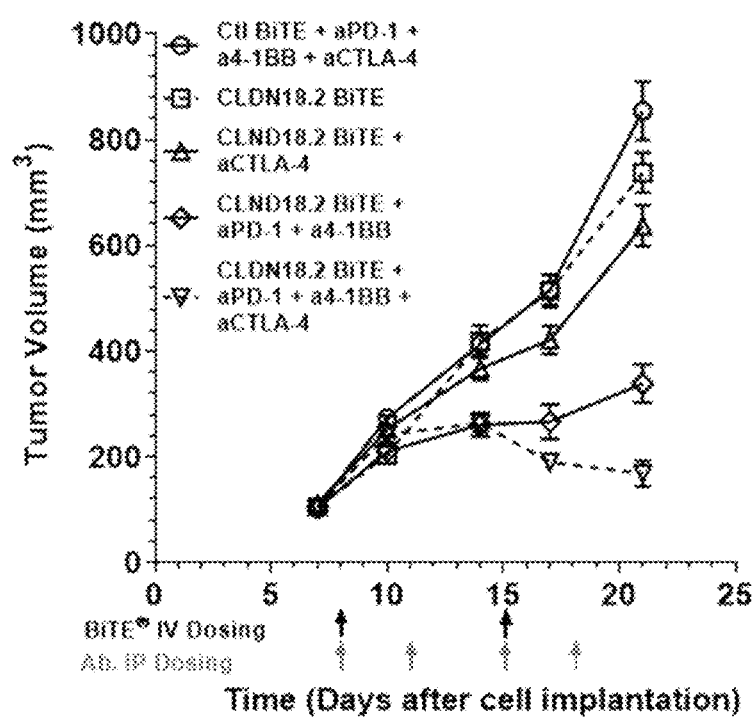
FIG. 1. Anti-tumor activity of single agent muCLDN18.2 bispecific T-cell engager molecule (BiTE®) molecule (□), muCLDN18.2 BiTE molecule/anti-CTLA4 dual combination (Δ), muCLDN18.2 BiTE molecule/anti-PD-1/anti-4-1BB triple combination (◊), control BiTE molecule/anti-PD-1/anti-4-1BB/anti-CTLA4 quadruple combination (■), or muCLDN18.2 BiTE molecule/anti-PD-1/anti-4-1BB/anti-CTLA4 quadruple combination (▽) therapy in the KPC-M5 model.

The present disclosure provides anti-CCR8 antibodies and methods of making and using said antibodies. The anti-CCR8 antibodies disclosed herein 1) are able to bind human and cynomolgus monkey CCR8 on tumor-resident Treg cells; 2) lead to specific depletion of tumor-resident Treg cells; 3) demonstrate an acceptable pharmacokinetic profile, and/or 4) display sufficient potency for the treatment of cancer. Anti-CCR8 antibodies of the present invention have an improved safety profile compared to other Treg-depleting therapeutic molecules targeting other markers that do not specifically deplete tumor-resident Tregs. In addition, anti-CCR8 depleting antibody treatment resulted in significantly increased CD8+/Treg ratios in tumors, thereby driving enhanced anti-tumor immunity.

The present invention includes anti-CCR8 antibodies that bind a unique epitope on CCR8 and do not block ligand binding to CCR8, and are therefore not neutralizing antibodies. Binding to this unique epitope, compared to antibodies that bind a different epitope, is thought to contribute to high affinity and bioactivity of the anti-CCR8 antibody, and also an acceptable pharmacokinetic profile.

In the presence of ligand (CCL1), the anti-CCR8 antibodies of the present invention, that bind a unique epitope on CCR8 and do not block ligand binding, demonstrate ADCC activity even at the highest concentrations of ligand tested in vitro. In contrast, anti-CCR8 antibodies that bind a different epitope (and block ligand binding) demonstrate reduced ADCC activity in the presence of increased levels of CCL1. Therefore, binding to this unique epitope is thought to contribute to greater potency (via ADCC) of the anti-CCR8 antibodies of the present invention, even in the presence of increased concentration of ligand. As CCL1 is highly expressed in tumors such as breast cancer (see e.g., Kuehnemuth et al., BMC Cancer 18, Article number: 1278 (2018)), anti-CCR8 antibodies that demonstrate ADCC activity in the presence of increased concentrations of ligand are preferred.

Anti-CCR8 antibodies of the present invention are preferably afucosylated and demonstrate enhanced ADCC activity.

Additional modes of action for depletion of Tregs contemplated by the anti-CCR8 antibodies or fragments thereof of the present invention include antibody-dependent cellular phagocytosis (ADCP) and/or complement-dependent cytotoxicity (CDC).

As used herein, an "antibody" is an immunoglobulin molecule comprising 2 heavy chains (HCs) and 2 light chains (LCs) interconnected by disulfide bonds. The amino terminal portion of each LC and HC includes a variable region of about 100-120 amino acids primarily responsible for antigen recognition via the CDRs contained therein. The CDRs are interspersed with regions that are more conserved, termed framework regions ("FR"). Each light chain variable region (LCVR) and heavy chain variable region (HCVR) is composed of 3 CDRs and 4 FRs, arranged from amino-terminus to carboxy-terminus in the following order: FR1, CDR1, FR2, CDR2, FR3, CDR3, FR4. The 3 CDRs of the LC are referred to as "LCDR1, LCDR2, and LCDR3," and the 3 CDRs of the HC are referred to as "HCDR1, HCDR2, and HCDR3." The CDRs contain most of the residues which form specific interactions with the antigen. The functional ability of an antibody to bind a particular antigen is, thus, largely influenced by the amino acid residues within the six CDRs. Assignment of amino acids to CDR domains within the LCVR and HCVR regions of the antibodies of the present invention is based on the well-known Kabat numbering convention (Kabat, et al., Ann. NY Acad. Sci. 190: 382-93 (1971); Kabat et al., Sequences of Proteins of Immunological Interest, Fifth Edition, U.S. Department of Health and Human Services, NIH Publication No. 91-3242 (1991)). It is understood that other numbering conventions may also be used, such as, for example, Chothia (Chothia et al., "Canonical structures for the hypervariable regions of immunoglobulins", Journal of Molecular Biology, 196, 901-917 (1987); Al-Lazikani et al., "Standard conformations for the canonical structures of immunoglobulins", Journal of Molecular Biology, 273, 927-948 (1997)), and/or North (North et al., "A New Clustering of Antibody CDR Loop Conformations", Journal of Molecular Biology, 406, 228-256 (2011)). An "anti-CCR8 antibody" is an antibody that binds CCR8.

Antibodies of the present invention may be an IgG1, IgG2, or IgG4. Preferably, antibodies of the present invention are IgG1. IgG1 antibodies are known to trigger ADCC. The antibodies of the present invention may be human or humanized antibodies. In the context of monoclonal antibodies, the terms "human" and "humanized" are well-known to those of ordinary skill in the art (Weiner L J, J. Immunother. 2006; 29: 1-9; Mallbris L, et al., J. Clin. Aesthet. Dermatol. 2016; 9: 13-15).

In addition, antibodies of the present invention are preferably afucosylated. Removal of the core fucose from the biantennary complex-type oligosaccharides attached to the Fc greatly increased ADCC effector function without altering antigen binding or CDC effector function. Several ways are known for reducing or abolishing fucosylation of Fc-containing molecules, e.g., antibodies. These include recombinant expression in certain mammalian cell lines including a FUT8 knockout cell line, variant CHO line Lec13, rat hybridoma cell line YB2/0, a cell line comprising a small interfering RNA specifically against the FUT8 gene, and a cell line co-expressing α-1,4-N-acetylglucosaminyltransferase III and Golgi α-mannosidase II. Alternatively, the Fc-containing molecule may be expressed in a non-mammalian cell such as a plant cell, yeast, or prokaryotic cell, e.g., E. coli. Zinc-finger nucleases are another known method of generating afucosylated antibodies. See e.g., Haryadi et al., Bioengineered 4:2, 90-94; March/April 2013; Ripka et al. Arch. Biochem. Biophys. 249:533-545 (1986); Yamane-Ohnuki et al. Biotech. Bioeng. 87: 614 (2004); Pereira et al. mAbs 2018 July; 10(5): 693-711.

The anti-CCR8 antibodies or fragments thereof are also contemplated to be in formats including scFv, scFab, Fab, bispecific T-cell engager molecules, and bispecific antibodies (which binds two different epitopes on the same antigen or binds two different antigens).

An scFv or Fab can be converted into an antibody by known methods (see e.g. Reader et al., Molec. Bio. 61, 801-815 (2019)). Constant region sequences are known in the art. Constant region sequences are also exemplified herein, for example LC and HC constant region amino acid sequences are given by SEQ ID NO: 1079 and SEQ ID NO: 1080, respectively.

In particular embodiments, the anti-CCR8 antibodies or antigen-binding fragments thereof, of the invention are heterodimeric antibodies (used interchangeably herein with "hetero immunoglobulins" or "hetero Igs"), which refer to antibodies comprising two different light chains and two different heavy chains. In some embodiments, a hetero Ig comprises two Fabs and an Fc region. In some embodiments, the two Fabs are each N-terminal to the Fc region. In some embodiments, the two Fabs are each C-terminal to the Fc region. In some embodiments at least one Fab is an anti-CCR8 antibody fragment of the present invention.

The heterodimeric antibodies can comprise any immunoglobulin constant region. The term "constant region" as used herein refers to all domains of an antibody other than the variable region. The constant region is not involved directly in binding of an antigen, but exhibits various effector functions. As described above, antibodies are divided into particular isotypes (IgA, IgD, IgE, IgG, and IgM) and subtypes (IgG1, IgG2, IgG3, IgG4, IgA1 IgA2) depending on the amino acid sequence of the constant region of their heavy chains. The light chain constant region can be, for example, a kappa- or lambda-type light chain constant region, e.g., a human kappa- or lambda-type light chain constant region, which are found in all five antibody isotypes.

The heavy chain constant region of the heterodimeric antibodies can be, for example, an alpha-, delta-, epsilon-, gamma-, or mu-type heavy chain constant region, e.g., a human alpha-, delta-, epsilon-, gamma-, or mu-type heavy chain constant region. In some embodiments, the heterodimeric antibodies comprise a heavy chain constant region from an IgG1, IgG2, IgG3, or IgG4 immunoglobulin.

An example of a heterodimeric antibody is a Duobody™. Duobodies can be made by the DuoBody™ technology platform (Genmab A/S) as described, e.g., in International Publication Nos. WO 2008/119353, WO 2011/131746, WO 2011/147986, and WO 2013/060867, Labrijn A F et al., PNAS, 110(13): 5145-5150 (2013), Gramer et al., mAbs, 5(6): 962-973 (2013), and Labrijn et al., Nature Protocols, 9(10): 2450-2463 (2014). This technology can be used to combine one half of a first monospecific antibody containing two heavy and two light chains with one half of a second monospecific antibody containing two heavy and two light chains. The resultant heterodimer contains one heavy chain and one light chain from the first antibody paired with one heavy chain and one light chain from the second antibody. When both of the monospecific antibodies recognize different epitopes on different antigens, the resultant heterodimer is a multispecific antibody.

Another exemplary method of generating multispecific antibodies is by the knobs-into-holes technology (Ridgway et al., Protein Eng., 9:617-621 (1996); WO 2006/028936). The mispairing problem of Ig heavy chains that is a chief drawback for making multispecific antibodies is reduced in this technology by mutating selected amino acids forming the interface of the heavy chains in IgG. At positions within the heavy chain at which the two heavy chains interact directly, an amino acid with a small side chain (hole) is introduced into the sequence of one heavy chain and an amino acid with a large side chain (knob) into the counterpart interacting residue location on the other heavy chain. In some instances, antibodies of the disclosure have immunoglobulin chains in which the heavy chains have been modified by mutating selected amino acids that interact at the interface between two polypeptides so as to preferentially form a multispecific antibody. The multispecific antibodies can be composed of immunoglobulin chains of the same subclass or different subclasses.

Yet another method of generating multispecific antibodies is the CrossMab technology. CrossMab are chimeric antibodies constituted by the halves of two full-length antibodies. For correct chain pairing, it combines two technologies: (i) the knob-into-hole which favors a correct pairing between the two heavy chains; and (ii) an exchange between the heavy and light chains of one of the two Fabs to introduce an asymmetry which avoids light-chain mispairing. See, Ridgway et al., Protein Eng., 9:617-621 (1996); Schaefer et al., PNAS, 108:11187-11192 (2011). CrossMabs can combine two or more antigen-binding domains for targeting two or more targets or for introducing bivalency towards one target such as the 2:1 format.

Hetero-Ig molecules may also comprise a non-canonical disulfide bond and the generation of an asymmetric cysteine interface, as described in International Publication No. WO 2022/040466 which also discloses specific pairs of mutations that may be used in antibodies of the present invention. To facilitate the association of a particular heavy chain with its cognate light chain, both the heavy and light chains may contain complimentary amino acid substitutions. As used herein, "complimentary amino acid substitutions" refer to a substitution to a positively-charged amino acid in one chain paired with a negatively-charged amino acid substitution in the other chain. For example, the heavy chain comprises at least one amino acid substitution to introduce a charged amino acid and the corresponding light chain comprises at least one amino acid substitution to introduce a charged amino acid, wherein the charged amino acid introduced into the heavy chain has the opposite charge of the amino acid introduced into the light chain. One or more positively-charged residues (e.g., lysine, histidine or arginine) can be introduced into a first light chain (LC1) and one or more negatively-charged residues (e.g., aspartic acid or glutamic acid) can be introduced into the companion heavy chain (HC1) at the binding interface of LC1/HC1, whereas one or more negatively-charged residues (e.g., aspartic acid or glutamic acid) can be introduced into a second light chain (LC2) and one or more positively-charged residues (e.g., lysine, histidine or arginine) can be introduced into the companion heavy chain (HC2) at the binding interface of LC2/HC2. The electrostatic interactions will direct the LC1 to pair with HC1 and LC2 to pair with HC2, as the opposite charged residues (polarity) at the interface attract. The heavy/light chain pairs having the same charged residues (polarity) at an interface (e.g. LC1/HC2 and LC2/HC1) will repel, resulting in suppression of the unwanted HC/LC pairings.

In some embodiments, a hetero Ig comprises at least one anti-CCR8 antibody fragment of the present invention. In particular embodiments, the anti-CCR8 antibody fragment is a Fab. In particular embodiments, the anti-CCR8 antibody fragment is a scFab. In particular embodiments, the anti-CCR8 antibody fragment is an scFv. Exemplary anti-CCR8 scFv amino acid sequences include, but are not limited to, any one of SEQ ID NOs: 1093-1124.

In some embodiments, a hetero Ig comprises an anti-CCR8 antibody fragment of the present invention attached to the hetero Ig. Said anti-CCR8 antibody fragment may be in any format as described herein, including scFv, Fab, or scFab. Such attachment may be via linker C-terminal or N-terminal to the Fc region, or N-terminal or C-terminal to another binding domain (e.g. Fab) in the hetero Ig. In some embodiments, a hetero Ig comprises at least one binding arm that is a single chain comprising an anti-CCR8 antibody fragment of the present invention and a further scFab or scFv.

The present invention also contemplates T cell engager ("TCE") molecules comprising an anti-CCR8 antibody fragment of the present invention. Such TCE molecules are preferably single chain TCE molecules. A single-chain TCE molecule having the following orientation: scFv that binds CCR8 (VH, linker, VL), linker, scFv that binds CD3 (VH, linker, VL) is contemplated. In an embodiment, the TCE molecule further comprises a scFc, and has the following orientation: scFv that binds CCR8 (VH, linker, VL), linker, scFv that binds CD3 (VH, linker, VL)-Linker-Fc1 (hinge, CH2, CH3), linker, Fc2 (hinge, CH2, CH3). In some embodiments, the scFv that binds CCR8 is an anti-CCR8 antibody fragment of the present invention.

The present invention also contemplates a TCE molecule having the following orientation from N-terminus to C-terminus: scFv that binds CCR8 (VH, linker, VL)-Linker-scFv that binds CD3 (VH, linker, VL)-Linker-Fc1 (CH2-CH3)-Linker-Fc2 (CH2-CH3). In an embodiment, the TCE molecule binds CCR8 and CD3. The present invention also provides a TCE molecule having the following orientation from N-terminus to C-terminus: scFv that binds CCR8 (VL-Linker-VH)-Linker-scFv that binds CD3 (VH-Linker-VL)-Linker-Fc1 (CH2-CH3)-Linker-Fc2 (CH2-CH3). In an embodiment, the TCE molecule binds CCR8 and CD3. In some embodiments, the scFv that binds CCR8 is an anti-CCR8 antibody fragment of the present invention.

The present invention contemplates a TCE molecule comprising an orientation, from N-terminus to C-terminus, of a scFab that binds CCR8 (VH, CH1, linker, VL, either Cκ or Cλ, linker, an scFv that binds CD3 (VH, linker, VL). In some embodiments, the scFab that binds CCR8 is an anti-CCR8 antibody fragment of the present invention.

An scFc is a fusion protein in which a CH2 and CH3 (Fc1) are joined via a linker to another CH2 and CH3 (Fc2) to form a continuous protein chain wherein the linker is long enough to allow the protein chain to fold back on itself.

A "single-chain antigen-binding fragment" ("scFab") is a fusion protein in which a VH and CH1 are joined via a linker to a VL and Cκ to form a continuous protein chain wherein the linker is long enough to allow the protein chain to fold back on itself and form a monovalent antigen binding site. The linker may be, for example, a (G4S)6, (G4S)7, or (G4S)8 linker.

The scFab, scFv, and/or scFc may also have a cysteine clamp. A "cysteine clamp" involves the introduction of a cysteine into a polypeptide domain at a specific location, typically through replacing an existing amino acid at the specific location, so that when in proximity with another polypeptide domain, also having a cysteine introduced at a specific location, a disulfide bond (a "cysteine clamp") may be formed between the two domains. In certain embodiments, an scFc comprises at least one cysteine clamp that results in a disulfide bond across both CH2 domains. In a further specific embodiment, an scFc comprises at least two cysteine clamps that results in a disulfide bond across both CH2 domains. In other embodiments, a binding construct's VH and VL domains may comprise the cysteine clamp(s) to result in disulfide bond formation between the VH and VL domains. These cysteine clamps will stabilize the VH and VL domains in an antigen-binding configuration.

A cysteine clamp may be naturally occurring or it may be a result of a molecule engineered to contain cysteines. For example, a scFab may have a natural cysteine clamp between the heavy and light chain constant domains. An scFab may also have a natural cysteine clamp between the heavy and light chain constant domains and an engineered cysteine clamp between cysteines at residue 44 of the heavy chain variable region and residue 100 of the light chain variable region. In addition, an anti-target scFv may also contain a cysteine clamp between cysteines at residue 44 of the heavy chain variable region and residue 100 of the light chain variable region, whereas an anti-CD3 scFv does not contain an engineered cysteine clamp. An scFc may contain hinge cysteine clamps, natural CH2/CH3 cysteine clamps, and/or an engineered CH2 cysteine clamp (intrachain).

Antigen binding fragments derived from an antibody can be obtained, for example, by proteolytic hydrolysis of the antibody, for example, pepsin or papain digestion of whole antibodies according to conventional methods. By way of example, antibody fragments can be produced by enzymatic cleavage of antibodies with pepsin to provide a 5S fragment termed F(ab')2. This fragment can be further cleaved using a thiol reducing agent to produce 3.5S Fab' monovalent fragments. Optionally, the cleavage reaction can be performed using a blocking group for the sulfhydryl groups that result from cleavage of disulfide linkages. As an alternative, an enzymatic cleavage using papain produces two monovalent Fab fragments and an Fc fragment directly. These methods are described, for example, by Goldenberg, U.S. Pat. No. 4,331,647, Nisonoff et al., Arch. Biochem. Biophys. 89:230, 1960; Porter, Biochem. J. 73:119, 1959; Edelman et al., in Methods in Enzymology 1:422 (Academic Press 1967); and by Andrews, S. M. and Titus, J. A. in Current Protocols in Immunology (Coligan J. E., et al., eds), John Wiley & Sons, New York (2003). pages 2.8.1-2.8.10 and 2.10A.1-2.10A.5. Other methods for cleaving antibodies, such as separating heavy chains to form monovalent light-heavy chain fragments (Fd), further cleaving of fragments, or other enzymatic, chemical, or genetic techniques may also be used, so long as the fragments bind to the antigen that is recognized by the intact antibody.

An antibody fragment may also be any synthetic or genetically engineered protein. For example, antibody fragments include isolated fragments comprising the light chain variable region, "Fv" fragments comprising the variable regions of the heavy and light chains, and recombinant single chain polypeptide molecules in which light and heavy variable regions are connected by a peptide linker (scFv proteins).

Another form of an antibody fragment is a peptide comprising one or more complementarity determining regions (CDRs) of an antibody. CDRs (also termed "minimal recognition units", or "hypervariable region") can be obtained by constructing polynucleotides that encode the CDR of interest. Such polynucleotides are prepared, for example, by using the polymerase chain reaction to synthesize the variable region using mRNA of antibody-producing cells as a template (see, for example, Larrick et al., Methods: A Companion to Methods in Enzymology 2:106, 1991; Courtenay-Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley-Liss, Inc. 1995)).

Antibodies and antigen-binding fragments of the present invention bind human CCR8. Preferably, antigen-binding fragments of the present invention bind human CCR8 at an epitope comprising or consisting of amino acid residues of SEQ ID NO: 82. Particularly, antigen-binding fragments of the present invention bind human CCR8 and do not block ligand binding to CCR8.

In the most general sense, a T cell engager ("TCE") molecule as described herein comprises a single chain polypeptide that can bind to two different antigens. A "TCE molecule" may be used interchangeably with a "BiTE molecule". A BiTE molecule can comprise an scFv or scFab, as long as it is bispecific, meaning that it binds two targets (target antigen (here, CCR8) and CD3) at the same time. A TCE molecule is an antigen-binding molecule. A TCE molecule of the present invention may comprise an scFab that binds a target (e.g. tumor or target antigen; CCR8) and an scFv that binds CD3. Such molecule may have the orientation, from N-terminus to C-terminus: scFab (VH, CH1, linker, VL, either Cκ or CX), linker, scFv (VH, linker, VL). Such molecules may alternatively have the orientation, from N-terminus to C-terminus: scFab (VL, either Cκ or Cλ, linker, VH, CH1), linker, scFv (VH, linker, VL). In some embodiments, the scFab binds CCR8. In particular embodiments, the TCE molecule comprises a Cκ. Such TCE molecule may have the following orientation, from N-terminus to C-terminus: scFv that binds CCR8 (VH, linker, VL), linker, scFv that binds CD3 (VH, linker, VL). In some such embodiments, the scFv or scFab that binds CCR8 is an anti-CCR8 antibody fragment of the present invention.

A TCE molecule of the present invention may also have a half-life extending (HLE) moiety. An HLE moiety may extend the in vivo half-life of the TCE molecules of the present invention. Nonlimiting examples of half-life extending moieties include an Fc polypeptide, a single-chain Fc polypeptide (scFc), albumin, an albumin fragment, a moiety that binds to albumin or to the neonatal Fc receptor (FcRn), a derivative of fibronectin that has been engineered to bind albumin or a fragment thereof, a peptide, a single domain protein fragment, or other polypeptide that can increase serum half-life. In other embodiments, a half-life-extending moiety can be a non-polypeptide molecule such as, for example, polyethylene glycol (PEG). In some embodiments, the HLE is a single-chain Fc ("scFc").

"Nucleic acid sequence" is intended to encompass a polymer of DNA or RNA, i.e., a polynucleotide, which can be single-stranded or double-stranded and which can contain non-natural or altered nucleotides. The terms "nucleic acid," "nucleic acid molecule," "nucleic acid sequence," and "polynucleotide" may be used interchangeably herein to refer to a polymeric form of nucleotides of any length, either ribonucleotides (RNA) or deoxyribonucleotides (DNA). These terms refer to the primary structure of the molecule, and thus include double- and single-stranded DNA, and double- and single-stranded RNA. The terms include, as equivalents, analogs of either RNA or DNA made from nucleotide analogs and modified polynucleotides such as, though not limited, to methylated and/or capped polynucleotides.

A DNA molecule of the present invention is a DNA molecule that comprises a non-naturally occurring polynucleotide sequence encoding a polypeptide having the amino acid sequence of at least one of the polypeptides in an anti-CCR8 antibody of the present invention (e.g., heavy chain, light chain, variable heavy chain, and variable light chain).

An isolated DNA encoding a HCVR region can be converted to a full-length heavy chain gene by operably linking the HCVR-encoding DNA to another DNA molecule encoding heavy chain constant regions. The sequences of human, as well as other mammalian, heavy chain constant region genes are known in the art. DNA fragments encompassing these regions can be obtained, e.g., by standard PCR amplification.

An isolated DNA encoding a LCVR region may be converted to a full-length light chain gene by operably linking the LCVR-encoding DNA to another DNA molecule encoding a light chain constant region. The sequences of human, as well as other mammalian, light chain constant region genes are known in the art. DNA fragments encompassing these regions can be obtained by standard PCR amplification. The light chain constant region can be a kappa or lambda constant region. In some embodiments, the light chain constant region is a kappa constant region.

The term "encoding" or "encodes" refers to a polynucleotide sequence encoding one or more amino acids. The term does not require a start or stop codon. The present invention encompasses nucleic acid molecules encoding anti-CCR8 antibody polypeptide sequences.

The polynucleotides of the present invention can be expressed in a host cell after the sequences have been operably linked to an expression control sequence. The expression vectors are typically replicable in the host organisms either as episomes or as an integral part of the host chromosomal DNA. Commonly, expression vectors will contain selection markers, e.g., tetracycline, neomycin, and dihydrofolate reductase, to permit detection of those cells transformed with the desired DNA sequences.

Transformed cells can be cultured under conditions that promote expression of the polypeptide, and the polypeptide recovered by conventional protein purification procedures. Polypeptides contemplated for use herein include substantially homogeneous recombinant mammalian polypeptides substantially free of contaminating endogenous materials. Cells containing the nucleic acid encoding an anti-CCR8 antibody of the present invention also include hybridomas.

A polynucleotide encoding an amino acid sequence of an anti-CCR8 antibody of the present invention can be any length as appropriate for the desired use or function, and can comprise one or more additional sequences, for example, regulatory sequences, and/or can be part of a larger nucleic acid, for example, a vector. The skilled artisan will appreciate that, due to the degeneracy of the genetic code, each of the polypeptide sequences disclosed herein is encoded by a large number of other nucleic acid sequences. Mutations can also be introduced into a nucleic acid without significantly altering the biological activity of a polypeptide that it encodes. For example, one can make nucleotide substitutions leading to amino acid substitutions at non-essential amino acid residues.

It will be appreciated that an anti-CCR8 antibody of the present invention may have at least one amino acid substitution, providing that the anti-CCR8 antibody retains the same or better desired binding specificity (e.g., binding to CCR8). Therefore, modifications to the anti-CCR8 antibody are encompassed within the scope of the invention. Such modifications may include amino acid substitutions, which may be conservative or non-conservative that do not destroy the desired binding capability of a binding construct. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position.

Human CCR8 includes the wild-type human CCR8 sequence and variants and isoforms thereof. The amino acid sequence of human CCR8 comprises the amino acid sequence of SEQ ID NO: 21. The term "variant," as used herein with respect to a nucleic acid sequence means (i) a portion or fragment of a referenced nucleotide sequence; (ii) the complement of a referenced nucleotide sequence or portion thereof; (iii) a nucleic acid that is substantially identical to a referenced nucleic acid or the complement thereof; or (iv) a nucleic acid that hybridizes under stringent conditions to the referenced nucleic acid, complement thereof, or a sequences substantially identical thereto. With respect to a peptide or polypeptide, the term "variant," as used herein, refers to a peptide or polypeptide that differs from a reference peptide or polypeptide in amino acid sequence by the insertion, deletion, or conservative substitution of amino acids, but retains at least one biological activity of the reference peptide or polypeptide. Variant can also mean a protein with an amino acid sequence that is substantially identical to a referenced protein with an amino acid sequence that retains at least one biological activity. The term "isoform" may be used herein to refer to a polypeptide or protein variant. Typically, a protein isoform is a member of a set of highly similar proteins that originate from a single gene or gene family and are the result of genetic differences. While some protein isoforms exhibit the same or similar biological functions, some isoforms have unique functions. Isoforms may be generated from alternative splicing, variable promoter usage, or other post-transcriptional modifications of a single gene.

A variant may be a nucleic acid sequence that is substantially identical over the full length of a full gene sequence or a fragment thereof. The nucleic acid sequence may be 80%, 81%, 82%, 83%, 84%, 85%, 86%, 87%, 88%, 89%, 90%, 91%, 92%, 93%, 94%, 95%, 96%, 97%, 98%, 99%, or 100% identical over the full length of the gene sequence or a fragment thereof. In other embodiments, a variant may be an amino acid sequence that is substantially identical over the full length of the amino acid sequence or fragment thereof. The amino acid sequence may be 80%, 81%, 82%, 83%, 84%, 85%, 86%, 87%, 88%, 89%, 90%, 91%, 92%, 93%, 94%, 95%, 96%, 97%, 98%, 99%, or 100% identical over the full length of the amino acid sequence or a fragment thereof.

The amino acid sequence of cynomolgus monkey CCR8 comprises the amino acid sequence of SEQ ID NO: 22.

The antibodies of the present invention can readily be produced in mammalian cells, non-limiting examples of which includes CHO, NSO, HEK293 or COS cells. The host cells are cultured using techniques well known in the art.

Vectors containing the polynucleotide sequences of interest (e.g., the polynucleotides encoding the polypeptides of the antibody and expression control sequences) can be transferred into the host cell by well-known methods, which vary depending on the type of cellular host. Examples of vectors include, but are not limited to, plasmids, viral vectors, non-episomal mammalian vectors and expression vectors, for example, recombinant expression vectors.

The recombinant expression vectors of the invention can comprise a nucleic acid of the invention in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see id.). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. The leader sequence may comprise an amino acid sequence of SEQ ID NO: 557 (MDMRVPAQLLGLLLLWLRGARC) which is encoded by SEQ ID NO: 558 (atggacatgagagtgcctgcacagctgctgggcctgctgctgctgtggctgagaggcgccagatgc). The leader sequence may comprise an amino acid sequence of SEQ ID NO: 559. (MAWALLLLTLLTQGTGSWA) which is encoded by SEQ ID NO: 560 (atggcctggg ctctgctgct cctcaccctc ctcactcagg gcacagggtc ctgggcc). The present invention contemplates antibody protein sequences without leader sequences.

The present invention also contemplates anti-CCR8 antibodies of the present invention that have clipping of the C-terminal lysine residue of the antibody HC. Anti-CCR8 antibodies comprising an antibody HC amino acid sequence lacking the C-terminal lysine residue are contemplated.

Various methods of protein purification may be employed to purify proteins, including, but not limited to, antibodies, and such methods are known in the art.

The anti-CCR8 antibodies of the invention can be biosynthesized, purified, and formulated for administration by well-known methods. For example, an appropriate host cell, such as HEK 293 or CHO, is either transiently or stably transfected with an expression system for secreting antibodies using a predetermined HC:LC vector ratio if two vectors are used, or a single vector system encoding both heavy chain and light chain. Vectors suitable for expression and secretion of antibodies from these commonly-used host cells are well-known. Following expression and secretion of the antibody, the medium is clarified to remove cells and the clarified medium is purified using any of many commonly-used techniques. For example, the medium may be applied to a Protein A or G column that has been equilibrated with a buffer, such as phosphate buffered saline (pH 7.4). The column is washed to remove nonspecific binding components. The bound antibody is eluted, for example, by a pH gradient (such as 0.1 M sodium phosphate buffer pH 6.8 to 0.1 M sodium citrate buffer pH 2.5). Antibody fractions are detected, such as by SDS-PAGE, and then are pooled. Further purification is optional, depending on the intended use. The antibody may be concentrated and/or sterile filtered using common techniques. Other materials than the antibody, such as host cell and growth medium components, and soluble aggregates and multimers of the antibody, may be effectively reduced or removed by common techniques, including size exclusion, hydrophobic interaction, cation exchange, anion exchange, affinity, or hydroxyapatite chromatography. The purity of the antibody after these chromatography steps is typically greater than 95%. The product may be frozen at −70° C. or may be lyophilized.

In exemplary aspects, an antibody of the present invention comprises a HC comprising a C-terminal lysine, as in SEQ ID NOs: 354, 364, 374, 384, 394, 404, 414, 424, 434, 444, 454, 464, 474, 484, 494, 504, 514, 524, 534, 544, 554, 1127, 1129, 1131, 1134, 1136, 1138, 1140, 1142, 1144, 1146, 1148, 1150, 1152, 1154, 1156, 1158, or 1160. In alternative aspects, the antibody comprises a HC without the C-terminal lysine, as in SEQ ID NOs: 573-592 or SEQ ID NOs: 1238-1254. In addition, the HC N-terminal glutamine and/or the N-terminal glutamic acid of may be converted to pyro-glutamic acid. Either form is envisioned for the antibodies of the present invention.

Similarly, in exemplary aspects, the anti-PD-1 antibody comprises a heavy chain comprising a C-terminal lysine, as in SEQ ID NOs: 41, for example. In alternative aspects, the anti-PD-1 antibody comprises the heavy chain of SEQ ID NOs: 636 without the C-terminal lysine. In other exemplary aspects, the anti-PD-1 antibody comprises a heavy chain comprising a C-terminal lysine. In alternative aspects, the anti-PD-1 antibody comprises a heavy chain without the C-terminal lysine.

An anti-CCR8 antibody of the present invention, or a pharmaceutical composition comprising the same, may be administered by parenteral routes, non-limiting examples of which are subcutaneous administration and intravenous administration. Intramuscular, intraarterial, intralesional, and peritoneal bolus injection are other possible routes of administration. An anti-CCR8 antibody can also be administered via infusion, for example intravenous or subcutaneous infusion. An anti-CCR8 antibody of the present invention may be administered to a patient with pharmaceutically acceptable carriers, diluents, or excipients in single or multiple doses. Optionally, the composition additionally comprises one or more physiologically active agents. Pharmaceutical compositions of the present invention can be prepared by methods well known in the art (e.g., Remington: The Science and Practice of Pharmacy, 22nd ed. (2012), A. Loyd et al., Pharmaceutical Press) and comprise an antibody, as disclosed herein, and one or more pharmaceutically acceptable carriers, diluents, or excipients.

As used interchangeably herein, "treatment" and/or "treating" and/or "treat" are intended to refer to all processes wherein there may be a slowing, interrupting, arresting, controlling, stopping, or reversing of the progression of the disorders described herein, but does not necessarily indicate a total elimination of all disorder symptoms. Treatment includes administration of an anti-CCR8 antibody of the present invention for treatment of a disease or condition in a human that would benefit from activity of an anti-CCR8 antibody of the present invention, and includes: (a) inhibiting further progression of the disease; and (b) relieving the disease, i.e., causing regression of the disease or disorder or alleviating symptoms or complications thereof.

Therapeutically effective amounts (or dose) of an anti-CCR8 antibody of the present invention can be administered. As used herein, an "effective amount" means the amount of an anti-CCR8 antibody of the present invention or pharmaceutical composition comprising such an antibody that will elicit the biological or medical response of or desired therapeutic effect on a tissue, system, animal, mammal, or human that is being sought by the researcher, medical doctor, or other clinician. An effective amount of the antibody may vary according to factors such as the disease state, age, sex, and weight of the individual, and the ability of the antibody to elicit a desired response in the individual. An effective amount is also one in which any toxic or detrimental effect of the antibody is outweighed by the therapeutically beneficial effects. Such benefit includes improving signs or symptoms of cancer. An effective amount of an anti-CCR8 antibody of the present invention may be administered in a single dose or in multiple doses. In determining the effective amount for a patient, a number of factors are considered by the attending medical practitioner, including, but not limited to: the patient's size (e.g., weight or mass), body surface area, age, and general health; the specific disease or disorder involved; the degree of, or involvement, or the severity of the disease or disorder; the response of the individual patient; the particular compound administered; the mode of administration; the bioavailability characteristics of the preparation administered; the dose regimen selected; the use of concomitant medication; and other relevant circumstances known to medical practitioners.

Dosages, frequency of administration, formulation, and effective amount of an antagonist of the PD-1/PD-L1 pathway, a bispecific T-cell engager molecule, and/or an agonist of an immune cell co-stimulatory receptor can also be determined as described herein.

Suitable PD-L1 antagonist antibodies for use in methods of the present invention include, but are not limited to, atezolizumab, avelumab, or durvalumab. Examples of PD-1 antagonist antibodies suitable for use in methods of the invention include, but are not limited to pembrolizumab, nivolumab, cemiplimab, pidilizumab, spartalizumab, camrelizumab, sintilimab, tislelizumab, toripalimab, dostarlimab, Antibody 20C1.006, zeluvalimab, Antibody 20A2.003, Antibody 22D4.006, or Antibody 22D4.017, and any of the PD-1 antagonist antibodies described in WO 2019/140196. Such methods include a method of treating cancer in a patient comprising administering an effective amount of an anti-CCR8 antibody of the present invention and a PD-L1 antagonist antibody or PD-1 antagonist antibody. Such methods also include a method of treating cancer in a patient comprising administering to the patient an effective amount of a Treg depleting antibody and one or more of a bispecific T-cell engager molecule, an agonist of a T cell co-stimulatory receptor, and an antagonist of the PD-1/PD-L1 pathway.

Bispecific T-cell engager molecules are recombinant protein constructs made from two flexibly linked antibody derived binding domains. A "bispecific T-cell engager molecule" may be used interchangeably with a "BiTE® molecule". One binding domain of bispecific T-cell engager is specific for a selected tumor-associated surface antigen on target cells; the second binding domain is specific for CD3, a subunit of the T cell receptor complex on T cells. By their particular design, bispecific T-cell engager molecules are uniquely suited to transiently connect T cells with target cells and, at the same time, potently activate the inherent cytolytic potential of T cells against target cells (Yang, Fa;

Wen, Weihong; Qin, Weijun (2016). "Bispecific Antibodies as a Development Platform for New Concepts and Treatment Strategies". International Journal of Molecular Sciences. 18 (1): 48 (2016)). A bispecific T-cell engager molecule is bispecific, meaning that it binds two targets (target antigen and CD3) at the same time. Sequences of examples of scFvs that bind CD3 include I2E and I2C and are described in Table 15. Suitable bispecific T-cell engager molecules for use in methods of the present invention include, but are not limited to, the bispecific T-cell engager molecules given in Table 15.

The CD3 binding domain I2C comprises LCDR1, LCDR2, LCDR3, HCDR1, HCDR2, HCDR3, VH, VL, and VH-VL amino acids sequences of SEQ ID NO: 87-95, respectively. The CD3 binding domain I2E comprises LCDR1, LCDR2, LCDR3, HCDR1, HCDR2, HCDR3, VH, and VL amino acids sequences of SEQ ID NO: 96-103, respectively. An example of a CD33 T cell engager molecule is one that comprises CDR, VH/VL region, and bispecific single chain molecule amino acids sequences of SEQ ID NO: 104-118. An example of an EGFRVIII T cell engager molecule is one that comprises CDR, VH/VL region, and bispecific single chain molecule amino acids sequences of SEQ ID NO: 119-129. An example of a MSLN T cell engager molecule is one that comprises CDR, VH/VL region, and bispecific single chain molecule amino acids sequences of SEQ ID NO: 130-141. An example of a CDH19 T cell engager molecule is one that comprises CDR, VH/VL region, and bispecific single chain molecule amino acids sequences of SEQ ID NO: 142-159. An example of a FLT3 T cell engager molecule is one that comprises CDR, VH/VL region, and bispecific single chain molecule amino acids sequences of SEQ ID NO: 160-170. An example of a DLL3 T cell engager molecule is one that comprises CDR, VH/VL region, and bispecific single chain molecule amino acids sequences of SEQ ID NO: 171-181. An example of a CD19 T cell engager molecule is one that comprises CDR, VH/VL region, and bispecific single chain molecule amino acids sequences of SEQ ID NO: 182-191. An example of a BCMA T cell engager molecule is one that comprises CDR, VH/VL region, and bispecific single chain molecule amino acids sequences of SEQ ID NO: 192-202. An example of a PSMA T cell engager molecule is one that comprises CDR, VH/VL region, and bispecific single chain molecule amino acids sequences of SEQ ID NO: 203-240. An example of a CD70 T cell engager molecule is one that comprises CDR, VH/VL region, and bispecific single chain molecule amino acids sequences of SEQ ID NO: 241-250. An example of a CLDN18.2 T cell engager molecule is one that comprises CDR, VH/VL region, and bispecific single chain molecule amino acids sequences of SEQ ID NO: 251-266. An example of a MUC17 T cell engager molecule is one that comprises CDR, VH/VL region, and bispecific single chain molecule amino acids sequences of SEQ ID NO: 267-302. An example of a CDH3 T cell engager molecule is one that comprises CDR, VH/VL region, and bispecific single chain molecule amino acids sequences of SEQ ID NO: 303-313. An example of a CD19 T cell engager molecule is one that comprises CDR, VH/VL region, and bispecific single chain molecule amino acids sequences of SEQ ID NO: 314-332.

Methods of the present invention include a method of treating cancer in a patient comprising administering an effective amount of an anti-CCR8 antibody of the present invention and a bispecific T-cell engager molecule. Such methods also include a method of treating cancer in a patient comprising administering to the patient an effective amount of a Treg depleting antibody and one or more of a bispecific T-cell engager molecule, an agonist of a T cell co-stimulatory receptor, and an antagonist of the PD-1/PD-L1 pathway.

An agonist of an immune cell co-stimulatory receptor is a molecule that binds a co-stimulatory receptor on an immune cell (such as an activated T cell) and promotes activity of the receptor. Examples of co-stimulatory receptors include CD2, TNFRSF4 (OX40), TNFRSF5 (CD40), TNFRSF7 (CD27), TNFRSF8 (CD30), TNFRSF9 (4-1BB), TNFRSF14 (HVEM), TNFRSF18 (GITR), and ICOS.

EXAMPLES

Example 1: CCR8 Specificity

Transfected cells were used to assess an antibody's binding specificity using flow cytometry on host Human Embryonic Kidney (HEK) 293T cells. Proteins were expressed on HEK 293T cells by transfection using human CCR8 (SEQ ID NO: 21), human CCR8 with an A27G point mutation (SEQ ID NO: 23), murine CCR8 (SEQ ID NO: 24), rat CCR8 (SEQ ID NO: 25), human CCR4 (SEQ ID NO: 26), or control expression vectors, Gibco™ Opti-MEM® media (Gibco), and 293Fectin™ reagent (Invitrogen) according to the manufacturer's instructions. Human T-cell lymphoma (HuT78) cell lines were also used to determine specificity to endogenously expressed CCR8.

Transfected HEK293T cells (24 hours after transfection) or HuT78 cells were resuspended in FACS buffer (PBS+2% Fetal Bovine Serum) and added to a 96-well plate. Hybridoma supernatant samples containing control antibodies 433H (BD Biosciences) or L263G8 (BioLegend), Antibody 1 IgG2, or Antibody 2 IgG2 were added at a final concentration of 5.0 µg/mL, cells were resuspended and incubated for 1 hour at 4° C. Plates were washed twice with FACS buffer, centrifuged to pellet the cells, and supernatant was removed and resuspended in FACS buffer to remove unbound antibodies.

Alexa Fluor 647 goat anti-human or rat IgG (Fcγ fragment specific) secondary antibodies (Jackson ImmunoResearch) made up in FACS buffer at 5.0 µg/mL were added to each well, and cells were resuspended and incubated for 15 minutes at 4° C. Plates were washed twice with FACS buffer, centrifuged to pellet the cells, and supernatant was removed and resuspended in FACS buffer to remove unbound secondary antibodies. Samples were resuspended in FACS buffer and read on either IntelliCyt® iQue or BD Accuri™ Flow Cytometer with an Intellicyt HyperCyt autosampler. Data derived from three cohorts of immunized animals are represented in Table 2.

TABLE 2

Binding of hybridoma supernatants (final Ab concentration at 5 µg/ml) to native conformation of CCR8 expressed on surface of cells as determined by FACS analysis.

| Antibody Hybridoma Supernatant | Human CCR8 [A27G] transiently expressed on HEK293T | HUT78 (endogenous human CCR8) | Rat CCR8 transiently expressed on HEK293T | Mouse CCR8 transiently expressed on HEK293T |
|---|---|---|---|---|
| Antibody 1 IgG2 | 36924 | 7756.9 | 105325 | 24729 |
| Antibody 2 IgG2 | 24205 | 1466.0 | 11023 | 3597 |
| L263G8 | 41425 | 4500 | N.D. | N.D. |
| SA214G2 | N.D. | N.D. | 1594 | 56829 |

These data demonstrate that hybridoma supernatant containing Antibody 1 IgG2 or Antibody 2 IgG2 bound human CCR8, including human CCR8 with the A27G mutation, rat, and mouse CCR8. None of the tested antibodies in supernatant bound to human CCR4 or 293T cells transfected with a control expression vector.

Example 2: Antibody Binding to Human and Cynomolgus Monkey Regulatory T Cells Binding of anti-CCR8 antibodies to endogenous CCR8 expressed by primary human and cynomolgus monkey regulatory T cells (human or cyno T-regs) was assessed by flow cytometry. Freshly isolated human (N=3) and cynomolgus monkey (N=2) peripheral blood mononuclear cells (PBMCs) were incubated with anti-CCR8 hybridoma culture supernatants at 20% final concentration in the presence of human Fc Block for one hour at 4° C. The primary antibodies were washed out from the cells, and the secondary anti-human or anti-rat IgG Fc antibodies and the cocktail of human/cyno cross-reactive anti-CD4/anti-CD25/anti-CD127 antibodies were added and incubated for thirty minutes at 4° C. 200,000 events were collected using FACS Canto flow cytometer, and binding was detected on the CD4+/CD25+/CD127− gated viable cells. The percent positive cells represents the percentage of human or cyno Tregs that were stained by the hybridoma culture supernatant containing the antibody under investigation. Control antibody 433H was purified and used at a concentration of 20 µg/ml. Results are shown in Table 3.

TABLE 3

Binding of hybridoma supernatants to primary human and cynomolgus monkey regulatory T cells.

| | CCR8 + CD127 − CD25 + CD4, % positive | | | | |
|---|---|---|---|---|---|
| Antibody | Human (3 samples) | | | Cynomolgus Monkey (2 samples) | |
| Antibody 2 IgG2 | 24.4 | 9.4 | 11.9 | 8.5 | 17.9 |
| Antibody 1 IgG2 | 23.3 | Not tested | 32.7 | 9.4 | 17.1 |
| Antibody 3 IgG2 | 55.6 | Not tested | 15.1 | 15.5 | 21.9 |
| Antibody 4 IgG2 | 72.6 | 26.5 | 34.8 | 7.7 | 17.6 |
| Hu IgG2b | 1.5 | 0.0 | 1.9 | 11.9 | 11.3 |
| 433H | 83.4 | 29.4 | 67.5 | 66.2 | 63.7 |
| Cyno IgG2a | 0.0 | 0.1 | 0.0 | 0.3 | 0.8 |

These data demonstrate that hybridoma supernatants containing antibodies of the present invention bind to endogenously expressed human and cynomolgus CCR8 expressed on primary T-cells.

Example 3: Epitope Binning

To enable epitope mapping of the anti-CCR8 antibodies, human CCR8-binding hybridoma supernatants were tested for binding to five biotinylated N-terminus CCR8 peptides generated from the 1-35 amino acid N-terminal portion of CCR8 (SEQ ID NO: 31). Each of the five peptides was twelve amino acids long with six amino acids overlapping. The amino acid sequences of Peptide 1, Peptide 2, Peptide 3, Peptide 4, and Peptide 5 comprise amino acids 1-12 (SEQ ID NO: 82), 7-18 (SEQ ID NO: 85), 13-24 (SEQ ID NO: 83), 19-30 (SEQ ID NO: 86), and 25-35 (SEQ ID NO: 84) of SEQ ID NO. 31, respectively.

The biotinylated human CCR8 peptides were captured on streptavidin polystyrene beads (Spherotech) in FACS buffer (PBS+2% Fetal Bovine Serum) at a final protein concentration of 50-100 ng/mL and incubated for 30 minutes at room temperature. Beads were washed twice with FACS buffer to remove unbound protein, centrifuged to pellet the beads, and resuspended and pooled together in StabilGuard (SurModics). The pooled biotinylated human CCR8 coated beads were added to hybridoma supernatant samples in a 96-well plate, such that the final antibody concentration was 5.0 µg/mL, and then incubated for one hour at room temperature.

Plates were washed twice with FACS buffer, centrifuged to pellet the beads, and supernatant was removed and resuspended in FACS buffer to remove unbound antibodies. Alexa Fluor 488 goat anti-human or rat IgG (Fcγ fragment specific) secondary antibodies (Jackson ImmunoResearch) made up in FACS buffer at 5.0 µg/mL were added to each well, resuspended with beads and incubated for 15 minutes at room temperature. Plates were washed twice with FACS buffer, centrifuged to pellet the beads, and supernatant was removed and resuspended in FACS buffer to remove unbound secondary antibodies. Samples were then resuspended in FACS buffer and read on either IntelliCyt® iQue Flow Cytometer.

Results are shown in Table 4. Data are represented as a ratio of geometric mean binding to beads coated with specific peptide divided by geometric mean of binding to a bead coated with a negative control peptide (peptide with unrelated sequence). A value above two represents presence of binding.

TABLE 4

Binding of hybridoma supernatants to biotinylated peptides coated on streptavidin beads as determined by FACS.

| | Peptide Antigen Coating: 100 ng/mL | | | | |
|---|---|---|---|---|---|
| Antibody | Peptide 1 | Peptide 2 | Peptide 3 | Peptide 4 | Peptide 5 |
| Antibody 2 IgG2 | 0 | 0 | 157 | 1 | 0 |
| Antibody 1 IgG2 | 3 | 0 | 0 | 0 | 1 |
| Antibody 3 IgG2 | 1 | 1 | 83 | 1 | 1 |
| Antibody 4 IgG2 | 1 | 2 | 8 | 2 | 1 |
| Antibody 5 IgG2 | 0 | 0 | 120 | 0 | 0 |
| Antibody 6 IgG2 | 0 | 0 | 154 | 0 | 0 |
| 433H | 1 | 1 | 1 | 1 | 1 |
| L263G8 | 1 | 0 | 0 | 1 | 0 |

Interestingly, hybridoma supernatants containing Antibody 1 IgG2 bound to the most N-terminal region (1-12), suggesting Antibody 1 IgG2 binds a unique epitope on CCR8, which is thought to contribute to the high affinity and bioactivity of Antibody 1 IgG2.

Example 4: Epitope Clustering

The extracellular domain of human CCR8 comprises three loops and a N-terminal peptide of 35 amino acids. For epitope mapping, the N-terminal peptide of human CCR8 (designated P_1-35 (SEQ ID NO: 31)) was divided into three consecutive segments (designated P_1-12 (SEQ ID NO: 82), P_13-24 (SEQ ID NO: 83), and P_25-35 (SEQ ID NO: 84)). To cover the adjacent N- or C-terminal regions of the consecutive segments, two additional overlapping fragments (designated P_7-18 (SEQ ID NO: 85 and P_19-30 (SEQ ID NO: 86)) were made. At the C-terminal end of the full-length N-terminal peptide and all truncated N-terminal peptides of human CCR8 described above, a V5 tag was fused via a G4S-linker. Following the V5 tag, chicken albumin was fused via a further G4S-linker followed by a FLAG tag, BAP (biotin acceptor protein) for in vivo biotinylation, and H3G, each fused via a SG-linker. All constructs described above were cloned into a pEFDHFR vector and transiently transfected into HEK 293 cells.

HEK 293 cells ($1\times10^8$) were resuspended in 100 ml FreeStyle expression medium (Gibco 12338-018) and transfected with 4 ml OptiMEM (Gibco 31985-047), 100 µl 293fectin (Invitrogen 12347-019), and 50 µg DNA encoding either the full-length or truncated N-terminal CCR8 constructs according to the manufacturers protocol. Cells were grown in FreeStyle expression medium for 72 hours at 130 rpm in a humidified incubator with 8% $CO_2$. Cells were centrifuged at 1,500 rpm for 10 minutes and the supernatant was harvested. 10 ml of the supernatant of each of the transfected cells or 9 ml of HEK 293 cells as negative control were 20× concentrated with Amicon Ultra-15 tubes (UFC901008) to 500 µL. For each of the full-length and truncated N-terminal CCR8 constructs, as well as HEK 293 negative control, $18\times10^6$ washed streptavidin-beads (Streptavidin Microspheres, 6 µm; Polysciences 24172-1) were resuspended in 500 µL of the concentrated supernatant and incubated slowly shaking for one hour. Beads coupled with the respective antigen or negative control were washed and stored at 4° C. overnight.

To verify expression and binding of the full-length and truncated N-terminal CCR8 constructs to streptavidin-beads, $2\times10^5$ beads per staining were incubated with 5 µg/mL of an anti-FLAG antibody (clone M2, Sigma F3165/F1804), 5 µg/mL of an anti-V5 antibody (clone SV5-Pk1; AbD Serotec, MCA 1360), and a 1:100 dilution of PE-labeled anti mouse Fcγ secondary antibody (Jackson 115-116-071). Antigen-bound beads were incubated with three different anti-human CCR8 antibodies. Binding of two of the anti-human CCR8 antibodies (clone L263G8; BioLegend, 360602 and clone 433H; BD 747578; 5 µg/ml each) was detected with a 1:100 dilution of a PE-labeled anti mouse Fcγ secondary antibody (Jackson 115-116-071). Binding of anti-human CCR8 antibody (polyclonal; Abcam, ab140796) was detected with a 1:50 dilution of PE-labeled anti goat Fcγ secondary antibody (Jackson 109-116-098).

Binding of CCR8-binding TCE molecules and scFab-containing CCR8-binding TCE molecules to the full-length and truncated N-terminal CCR8 constructs bound to streptavidin-beads was determined. In the most general sense, a T cell engager ("TCE") molecule comprises a single chain polypeptide that can bind to two different antigens. The term "TCE molecule" may be used interchangeably with the terms "BiTE® molecule" or "bispecific T-cell engager" molecule. Tested TCE molecules included molecules comprising an scFab that binds CCR8 and an scFv binds CD3 (scFab-containing TCE molecules), and molecules comprising an scFv that binds CCR8 and an scFv that binds CD3. The tested TCE molecules also included an scFc at the C-terminus as a half-life extending (HLE) moiety. The CDRs of Antibody 1 antibodies are the same as the CDRs of TCE1 (TCE1 CDR amino acid sequences comprise SEQ ID NOs 561 to 566). The CDRs of Antibody 2 IgG2 are the same as the CDRs of TCE2 (TCE2 CDR amino acid sequences comprise SEQ ID NOs 567 to 572).

Beads were incubated with 5 μg/mL of the respective TCE molecule. Binding of these CCR8-binding TCE molecules and scFab-containing CCR8-binding TCE molecules was detected using 2 μg/ml of an anti-Histidine-antibody (clone AD1.1.10; AbD Serotec MCA 1396) and a 1:100 dilution of a PE-labeled anti mouse Fcγ secondary antibody (Jackson 115-116-071). All antibodies, CCR8-binding TCE molecules, and scFab-containing CCR8-binding TCE molecules were diluted in PBS with 2% FBS and all incubations were performed at 4° C. for 45 minutes (primary antibodies) or for 30 minutes (secondary antibodies). Washes were performed using PBS with 2% FBS, and the final suspension buffer prior to FACS analysis was also PBS with 2% FBS. Antibody and TCE binding was detected using an Intellicyte IQue. Changes in mean fluorescence were analyzed with an Intellicyte IQue and FlowJo. Binding to the various full-length and truncated N-terminal CCR8 constructs was reflected as a positive signal detected by flow cytometry.

Expression and binding of the full-length and the various truncated N-terminal CCR8 constructs to streptavidin-beads were verified by flow cytometry, as shown in Tables 5 and 6.

TABLE 5

Flow Cytometry Binding Analysis of CCR8 Antibodies to Full-length or Truncated N-terminal Peptides of Human CCR8.

| Sample | Beads (control) | HEK (control) | 1-35 | 1-12 | 7-18 | 13-24 | 19-30 | 25-35 |
|---|---|---|---|---|---|---|---|---|
| | | | Median Fluorescence of Sample/Median Fluorescence of Negative Control | | | | | |
| PBS | 0.9 | 0.9 | 0.9 | 0.9 | 0.9 | 0.9 | 0.9 | 1.9 |
| Flag | 0.9 | 0.9 | 522.0 | 596.0 | 588.7 | 628.1 | 589.5 | 582.0 |
| V5 Tag | 0.9 | 0.9 | 952.6 | 1091.5 | 1085.9 | 1303.2 | 1016.2 | 1094.2 |
| anti-CCR8 (clone L263G8) | 1.2 | 0.9 | 751.2 | 0.9 | 0.9 | 284.8 | 0.9 | 0.9 |
| anti-CCR8 (clone BV510) | 1.8 | 0.9 | 290.2 | 0.9 | 0.9 | 300.3 | 0.9 | 0.9 |
| anti-CCR8 (polyclonal) | 0.9 | 1.0 | 259.7 | 0.9 | 222.6 | 385.6 | 0.9 | 0.9 |

The data in Table 5 demonstrate that anti-human CCR8 antibodies bound the full-length N-terminal peptide of human CCR8 P_1-35, indicating they recognized the N-terminal peptide of human CCR8. None of the antibodies showed binding to either streptavidin-beads alone or to the HEK 293 control. The anti-human CCR8 antibodies (clone L263G8 and clone 433H) showed the same binding pattern, while the polyclonal anti-human CCR8 antibody showed additional binding to the overlapping fragment P_7-18.

TABLE 6

Flow Cytometry Binding Analysis of CCR8 Antibodies and scFab-containing CCR8-binding TCE molecules to Full-length or Truncated N-terminal Peptides of Human CCR8.

| Construct | Beads (control) | HEK (control) | 1-35 | 1-12 | 7-18 | 13-24 | 19-30 | 25-35 |
|---|---|---|---|---|---|---|---|---|
| | | | Median Fluorescence of Sample/Median Fluorescence of Negative Control | | | | | |
| PBS | 1.0 | 1.0 | 1.0 | 1.0 | 1.0 | 1.0 | 1.0 | 1.0 |
| CCR8 TCE1 scFab × I2E × scFc | 1.2 | 1.1 | 470.8 | 413.5 | 1.0 | 1.1 | 1.1 | 1.1 |
| CCR8 TCE1 scFv × I2E × scFc | 1.1 | 1.0 | 381.8 | 306.2 | 1.0 | 1.1 | 1.1 | 1.0 |
| CCR8 TCE2 scFab × I2E × scFc | 1.0 | 1.0 | 814.0 | 1.0 | 1.0 | 432.5 | 1.1 | 1.0 |
| Negative control | 1.0 | 1.0 | 1.0 | 1.0 | 1.0 | 1.0 | 1.0 | 1.1 |

The data in Table 5 demonstrate that CCR8-binding TCE molecules and scFab-containing CCR8-binding TCE molecules bound to the full-length N-terminal CCR8 peptide P_1-35. TCE2 bound to the truncated N-terminal CCR8 peptide P_13-24. Interestingly, TCE1 bound to the truncated N-terminal CCR8 peptide P_1-12, demonstrating that TCE1 binds a unique epitope on CCR8.

Example 5: Antibody Functional Activity

Hybridoma supernatants were tested for blocking of CLL-1 dependent chemotaxis in HUT78 cells (human T lymphocyte cell line that endogenously expresses CCR8). Testing was done in a 96-well transwell plate with 5 µm pore size in complete HUT-78 growth medium. The cells were pre-incubated with purified antibodies for thirty minutes and transferred to the top transwell chambers (total 50 µl volume and 50,000 cells per well).

Recombinant Hu CCL1 (R&D) was prepared at suboptimal concentration of 100 µM and added to the bottom transwell chambers at 100 µl per well. The transwell plates were incubated at 37° C. with 5% $CO_2$ overnight. The suboptimal concentration of CCL1 was established based on the cells' chemotactic dose response curve and allowed for selection of antibodies with $IC_{50} \leq 100$ µM. At the end of incubation, the top chambers were removed and 50 µl/well of CellTiterGlo reagent (Promega) was added to the bottom chambers with migrated cells. After ten minutes of incubation at room temperature, 100 µl of the mixture from the bottom chamber was transferred to the black well clear bottom plates for Luminescence readout (Envision plate reader). Percent inhibition of chemotaxis was calculated using Basal and Max chemotaxis control wells present on each plate. Percent inhibition and $IC_{50}$ values were calculated using Screener analysis software. The average of three experiments is shown in Table 7.

TABLE 7

Inhibition of CCR8-expressing HUT78 chemotaxis following treatment with antibody.

| Antibody | Percent Inhibition ($IC_{50}$ nM) |
| --- | --- |
| Antibody 1 IgG1 | >690 |
| Antibody 2.2 IgG1 | 0.076 |
| Antibody 3.0 IgG1 | 3.7 |
| Antibody 4.0 IgG1 | 8.4 |
| Antibody 5.0 IgG1 | 13.6 |
| Antibody 6.0 IgG1 | 20.1 |

These data demonstrate that Antibody 1, which binds a unique epitope, does not block chemotactic activity, despite binding CCR8, and is not a neutralizing antibody. These data demonstrate that Antibody 1 does not block ligand binding to CCR8. Similar data were also observed in an experiment testing antibodies in hybridoma supernatant.

Example 6: Antibody-Mediated Cytotoxicity Assay

To determine if anti-CCR8 antibodies can mediate antibody-mediated cytotoxicity (ADCC), a killing assay was developed using HUT78.luc target cells, which were stably transfected with a luciferase reporter gene and express endogenous human CCR8. Primary NK cells with VF phenotype from six different donors were used as effector cells (for data from Table 8a and Table 8b); Primary NK cells with VF phenotype from two different donors were used as effector cells (for data from Table 8c), or Primary NK cells with FF phenotype from three different donors were used with three separate bleeds for one of them as effector cells (for data from Table 8d). NK cells negative selection was done from leukopak using StemCell EasySep Hu NK isolation kit.

Purified antibodies were tested in a range of concentrations, starting at 5 µg/ml (35 nM with 1:10 dilutions). The antibodies were incubated with target and effector cells in a 384-well plate at 5% $CO_2$ 37° C. in a humidified incubator overnight. The effector to target ratio was 5:1 with 20,000 target cells per well in total 50 µl per well. At the end of the incubation, 30 µl per well of BioGlo (Tables 8a and 8b) or SteadyGlo (Table 8c) reagent was added, mixed, and luminescence was read on an Envision plate reader. Luminescence signal was proportional to the amount of viable target cells. The percent ADCC was calculated as (1−(luminescence signal in the presence of Ab/luminescence signal for T+E cells alone))×100. The $EC_{50}$ was calculated using GraphPad Prism 7. Results are shown in Tables 8a, 8b, 8c, and 8d (N.D. means not determined).

TABLE 8a

Anti-CCR8 Antibody mediated ADCC of CCR8-expressing HUT78 cells (EC50 pM). Percent Non-Viable cells ($EC_{50}$ pM)

| Antibody | Donor 1 | Donor 2 | Donor 3 |
| --- | --- | --- | --- |
| Antibody 1 IgG1 | <0.256 | 5.582 | 1.3 |
| Antibody 1.1 IgG1 | <0.256 | 8.129 | 2.2 |
| Antibody 2.1 IgG1 | <0.256 | 13.3 | 1 |
| Antibody 2.2 IgG1 | <0.256 | 6.035 | 1.8 |
| Antibody 3.0 IgG1 | <0.256 | 15.47 | N.D. |
| Antibody 4.0 IgG1 | <0.256 | 217.9 | N.D. |
| Antibody 5.0 IgG1 | <0.256 | 167 | N.D. |
| Antibody 6.0 IgG1 | 2 | 37.39 | N.D. |

TABLE 8b

Anti-CCR8 Antibody mediated ADCC of CCR8-expressing HUT78 cells (EC50 pM). Percent Non-Viable cells ($EC_{50}$ pM)

| Antibody | Donor 4 | Donor 5 | Donor 6 |
| --- | --- | --- | --- |
| Antibody 5.1 IgG1 | 3.684 | 0.8653 | 4.891 |
| Antibody 5.2 IgG1 | 6.198 | 1.008 | 6.112 |
| Antibody 5.3 IgG1 | 3.342 | 0.6424 | 3.479 |
| Antibody 5.4 IgG1 | 3.429 | 0.8886 | 4.615 |
| Antibody 5.5 IgG1 | 4.891 | 0.837 | 3.771 |
| Antibody 6.1 IgG1 | 4.518 | 1.047 | 3.617 |
| Antibody 6.2 IgG1 | 4.119 | 2.04 | 5.136 |

TABLE 8c

Anti-CCR8 Antibody mediated ADCC of CCR8-expressing HUT78 cells (EC50 pM). Percent Non-Viable cells ($EC_{50}$ pM)

| Antibody | Donor 7 |
| --- | --- |
| HC SEQ ID NO: 1239; LC SEQ ID NO: 1130 | 0.52 |
| HC SEQ ID NO: 1240; LC SEQ ID NO: 1132 | 0.28 |
| HC SEQ ID NO: 1238; LC SEQ ID NO: 1128 | 0.48 |

TABLE 8c-continued

Anti-CCR8 Antibody mediated ADCC of
CCR8-expressing HUT78 cells (EC50 pM).
Percent Non-Viable cells ($EC_{50}$ pM)

| Antibody | Donor 7 |
|---|---|
| HC SEQ ID NO: 573;<br>LC SEQ ID NO: 16 | 1.14 |

TABLE 8d

Anti-CCR8 Antibody mediated ADCC of
CCR8-expressing HUT78 cells (EC50 pM).
Percent Non-Viable cells ($EC_{50}$ pM)

| Antibody | Donor 8 | Donor 9 |
|---|---|---|
| huCCR8(32360LC:K38R)_huIgG1z(mAb)<br>(HC SEQ ID NO: 1237; LC SEQ ID NO: 1126) | 3.0 | 2.7 |

These data demonstrate that antibodies of the present invention exhibit ADCC based killing via CCR8 receptor expressed on the surface of HUT78 cells.

Example 7: Affinity of Anti-CCR8 Antibodies

Hybridoma supernatants containing Antibody 1 IgG2, Antibody 2 IgG2, or Antibody 4 IgG2 were evaluated by a Kinetic Exclusion Assay (KinExA) for their affinity to native cynomolgus CCR8 transiently expressed on 293T cells or to native human CCR8 expressed on HUT78 cells.

Cynomolgus CCR8: 293T Cells

KinExA was performed in which the $K_d$ was determined from the concentration of free antibody that remains in solution after equilibrium has been established between the antibody and the cell-surface-expressed antigen. KinExA provides a more sensitive determination of binding affinity for the native form of CCR8 compared to soluble CCR8. The Kinetic Exclusion Assay method was performed as essentially described in Rathanaswami et al. Anal. Biochem: 373(1): 52-60 (2008).

Briefly, equilibrium sets were set up for each antibody using either human CCR8-expressing HUT78 cells or cynomolgus monkey CCR8-expressing 293T cells. The cells were counted using a hemocytometer. The HUT78 cells were titrated and incubated with two different constant antibody concentrations, one at 48 pM and the other at 2 nM, in HUT media (RPMI 1640, 10% FBS, 10 mM HEPES, 2 mM L-Glut, 1 mM Sod. Pyr, 0.1 mM NEAA, 50 uM 2-ME) with 0.05% Sodium Azide. For the high [Ab] equilibrium set, HUT78 cells were titrated from 62.5 million per milliliter concentration 1:2 for 10 points in eppendorf tubes and equilibrated with 2 nM antibody in a total volume of 400 µl. For the low [Ab] equilibrium set, HUT78 cells were titrated from 3.89 million per milliliter concentration, 1:2 for 10 points in 50 ml Fulcon tubes and equilibrated with 48 pM antibody in a total volume of 15.5 mL.

The cyno CCR8-expressing 293T cells were titrated and incubated with two different constant antibody concentrations, one at 118 pM and the other at 5 nM, in 293T media (Freestyle expression 293T media with 2% FBS and 50 µg/ml G418) with 0.05% Sodium Azide. For the high [Ab] equilibrium set, 293T cells were titrated from 25 million per milliliter concentration 1:3 for 10 points in eppendorf tubes and equilibrated with 5 nM antibody in a total volume of 200 µl. For the low [Ab] equilibrium set, 293T cells were titrated from 0.98 million per milliliter concentration 1:3 for 10 points in 15 ml Fulcon tubes and equilibrated with 118 pM antibody in a total volume of 10.2 mL.

For each equilibrium set, reference point controls included a sample with cell media only and a sample without cells. The equilibrium sets were incubated for 24 hours at room temperature, with shaking. After 24 hours of incubation, the supernatants were separated from the cell pellets via centrifugation at 500×g for five minutes. The supernatants of both high [Ab] and low [Ab] equilibrium sets were then run through a KinExA 3200 machine.

Each equilibrium sample set was read in duplicate on the KinExA machine. For low [Ab] equilibrium samples, 6.8 mL and 4.6 mL of each sample were run in duplicate, respectively, for human and cyno CCR8 equilibrium experiments. For high [Ab] equilibrium samples 16 µL and 75 µL of each sample were run in duplicate, respectively for human and cyno CCR8 equilibrium experiments.

PMMA (Polymethyl Methacrylate Particles) beads were coated with goat anti-human Fc Ab or Goat anti-hIgG (H+L) Ab and subsequently blocked with a blocking solution (1×PBS pH7.4+10 mg/mL BSA+0.05% Sodium Azide). For each equilibrium sample the free [Ab] was detected by running the equilibrium samples through the coated beads followed by a quick wash with the running buffer (1×PBS pH7.4+1% BSA+0.05% Sodium Azide). The secondary detection antibody (goat anti-huIgG (H+L) Alexa 647) was run through the flow cell at 680 ng/mL and 500 µL per run. The KinExA voltage output signal was used in KinExA software to calculate the $K_d$. From the plots at two different initial total [Ab] concentrations the $K_d$ was obtained from curve fitting using n-curve analysis in KinExA Pro software version 4.3.11 (Sapidyne Instruments Inc.). The 95% confidence interval was given as $K_d$ low and $K_d$ high. Results are shown in Table 9.

TABLE 9

Determination of Kd of hybridoma supernatants
containing CCR8 antibodies for
cell-membrane-expressed cynomolgus CCR8.

| | | 95% confidence interval | |
|---|---|---|---|
| Antibody | Kd | Kd Low | Kd High |
| Antibody 1 IgG2 | 229 pM | 73.2 pM | 552.9 pM |
| Antibody 2 IgG2 | >50 nM | <1.85 nM | >500 nM |
| Antibody 4 IgG2 | >50 nM | <2 pM | >179 nM |

Native Human CCR8 Expressed on HUT78 Cells

Cells in media were serially diluted and incubated with 48 pM or 2 nM active binding site concentration of antibody in media in the presence of 0.05% NaN3, and allowed to equilibrate. The free mAb left in the supernatant was measured as described above. The percent free antibody was plotted against the cell concentration. N-curve analysis was performed using the equilibrium; a whole cell method was performed to determine optimal values for $K_d$ and the antigen expression level. The 95% confidence intervals were determined by the software by changing iteratively the optimized value for Kd or antigen expression level while keeping other parameters at their optimal values.

The affinities of tested antibodies to endogenous human CCR8 expressed on HUT78 cells is shown in Table 10.

TABLE 10

Affinity of hybridoma supernatant containing antibodies
to endogenous human CCR8 expressed on HUT78 cells.

| Antibody | Kd | 95% confidence interval | |
|---|---|---|---|
| | | Kd Low | Kd High |
| Antibody 1 IgG2 | 216 pM | 112.5 pM | 420.1 pM |
| Antibody 2 IgG2 | >5 nM | 816 pM | >50 nM |
| Antibody 4 IgG2 | 378 pM | 275.5 pM | 540.6 pM |

IgG2 antibodies were further engineered to increase affinity to human and/or cynomolgus monkey CCR8.

Example 8: Cynomolgus CCR8 T4R Variant: CHO Cells

CHO cells expressing cynomolgus monkey CCR8 (comprising threonine at position four; SEQ ID NO: 22) or cynomolgus monkey CCR8 (T4R; comprising arginine at position four; SEQ ID NO: 556) were incubated with decreasing concentrations of anti-CCR8 antibodies (0.005-100 nM, step 1:3, 10 steps) for 30 minutes at 4° C. Bound anti-CCR8 antibody molecules were detected with Alexa Fluor 647 conjugated Goat anti-Human IgG (H+L). Cells were subsequently stained with Zombie Violet viability dye, fixed with 4% PFA on ice, and detected by fluorescence cytometry. Equilibrium dissociation constant ($K_d$) values were calculated by non-linear regression with the one site specific binding evaluation tool of the GraphPad Prism software. The affinities of the anti-CCR8 antibodies are shown in Table 11. "N.D." means not detectable.

TABLE 11

Affinity of anti-CCR8 antibodies to cell-membrane-
expressed cynomolgus CCR8 variant T4R.

| Antibody | Cell based affinity cyno CCR8 Kd [nM] | Cell based affinity cy CCR8 (T4R) Kd [nM] |
|---|---|---|
| HuIgG1 Negative Control | N.D. | N.D. |
| Antibody 1 IgG1 | 0.635 | N.D. |
| Antibody 1.1 IgG1 | 0.172 | N.D. |
| Antibody 2.2 IgG1 | 0.399 | 0.989 |

These data demonstrate that binding of Antibody 1 antibodies to cynomolgus CCR8 was reduced with the T4R mutation while Antibody 2 was unaffected, consistent with their respective epitope binning and clustering determined above. These data demonstrate that antibodies that bind a unique epitope as described herein bind CCR8 at threonine at position four.

Example 9: IgG1 Afucosylated Antibodies

Afucosylated anti-CCR8 IgG1 antibodies were generated. Examples of antibody amino acid sequences of afucosylated antibodies are SEQ ID NOs.: 346 to 555, SEQ ID NOs: 1125-1160, and SEQ ID NOs: 1238-1254. SEQ ID NOs 573 to 592 and SEQ ID NOs: 1237-1254 correspond to an antibody HCs without the C-terminal lysine. Antibodies were designated according to the parental molecule. For example, Antibody 5.1, Antibody 5.2, Antibody 5.3, Antibody 5.4, Antibody 5.5, Antibody 5.6, Antibody 5.7, Antibody 5.8, and Antibody 5.9 all refer to antibodies engineered from Antibody 5. "Antibody 1 IgG2" and "Antibody 2 IgG2" refer to an IgG2 antibody, whereas "Antibody 1 IgG1" and "Antibody 2 IgG1" refer to an IgG1 afucosylated antibody. In addition, and for example, Antibody 2 IgG1 molecules were further engineered from Antibody 2 IgG2 antibodies, as described in the sequences table (Table 16), to obtain Antibody 2.1 and Antibody 2.2 IgG1 afucosylated antibodies. Antibody 2.2 IgG1, for example, comprises HCDR1, HCDR2, HCDR3, LCDR1, LCDR2, LCDR3, HCVR, LCVR, HC, and LC amino acid sequences as set out in SEQ ID NOs. 376-385, respectively.

Engineered molecules may demonstrate desirable properties, such as, but not limited to, increased affinity to human and/or cynomolgus monkey. Sites of engineering are described in the sequence table (Table 19).

The Examples described herein demonstrate the activity of afucosylated anti-CCR8 antibodies, for example ADCC activity (Example 16), in vivo studies demonstrating anti-tumor activity (Example 11) and increased survival (Example 12).

Example 10: Treg Depleting Combination Therapy

Efficacy of administration of a bispecific T-cell engager molecule, PD-1 antagonist antibody, 4-1BB agonist antibody, and a Treg depleting antibody was determined. Mice genetically engineered to express a humanized CD3ε molecule at the surface of their T cells were implanted subcutaneously with the KPC-M5 syngeneic tumor cell line with an inoculum consisting of $10^5$ KPC-M5 cancer cells in 50 μl of PBS mixed with 50 μl of Matrigel. When tumors reached a volume of 50-100 mm$^3$, mice were injected with one or more of a bispecific T-cell engager molecule (a bispecific molecule that binds CD3 and a target antigen), PD-1 antagonist antibody, 4-1BB agonist antibody, and a Treg depleting antibody, and tumor volume was measured over time. Depending on the bispecific T-cell engager molecule administered, the bispecific T-cell engager molecule was administered at doses ranging from 15 to 5,000 μg/kg.

Tumor-bearing mice were injected once weekly with an anti-mouse CLDN18.2 BiTE® molecule via intravenous administration at a dose of 150 μg/kg. Mice were co-injected via intravenous administration every three days with an anti-mouse PD-1 mIgG1 antagonist antibody at a dose of 100 μg per mouse, an agonist antibody to the 4-1BB co-stimulatory receptor (anti-mouse 41BB rIgG1 (Clone LOB12.3, BioXcell)) at a dose of 150 μg per mouse, and/or with a Treg-depleting antibody (mIgG1) at a dose of 300 μg per mouse. Tumor volume was measured on days 7, 10, 14, 17, and 20 post-implantation.

The data in FIG. 1 demonstrate that while minimal activity was observed with combination of anti-CTLA4 with 4-1BB agonist+anti-PD-1 or CLDN18.2 BiTE® molecule alone, the quadruple combination of CLDN18.2 BiTE® molecule+4-1BB agonist+anti-PD-1+anti-CTLA4 demonstrated robust efficacy, similar to that observed with CD4$^+$ T cell depletion. Notably, this anti-tumor effect was associated with a pronounced increase in the intra-tumoral CD8$^+$ T cell:Treg ratio. Taken together, these data demonstrate the selective activity and dependence of bispecific T-cell engager molecules on CD8$^+$ T cells and suggest context dependent inhibitory roles for CD4$^+$ T cells on bispecific T-cell engager molecule-mediated anti-tumor efficacy. The results also suggest a potential dominant role for Tregs in suppressing the activity bispecific T-cell engager+anti-4-1BB+anti-PD-1 combination immunotherapy.

Example 11: CCR8 Depleting Antibody is Efficacious in the MC38 In Vivo Tumor Model Anti-tumor activity of afucosylated anti-CCR8 mIgG2a in the MC38 syngeneic tumor model was determined. MC38 tumor cells were implanted subcutaneously in the right flank of female hCD3eKI animals on study day 0. On day 10, tumors were assigned to different treatment groups (n=10/group) with an average tumor volume of 99.93 mm$^3$. Animals were dosed intra-peritoneally with 10 mg/kg of either control isotype mIgG2a or anti-CCR8 afucosylated mIgG2a on study days 11, 14, 17 and 20 (Q3D×4). The anti-CCR8 afucosylated mIgG2a antibody comprises LCDR1, LCDR2, LCDR3, HCDR1, HCDR2, HCDR3, LCVR, HCVR, LC, and HC amino acid sequences of SEQ ID NOs 637 through 646, respectively.

Tumor volume was measured twice per week. Statistical analysis to evaluate effect of treatment on tumor size over time of anti-CCR8 antibody relative to isotype control was performed using Linear Mixed Effects (LME) model with Dunnett's post-hoc analysis. **** indicates p<0.0001.

Figure 2A:
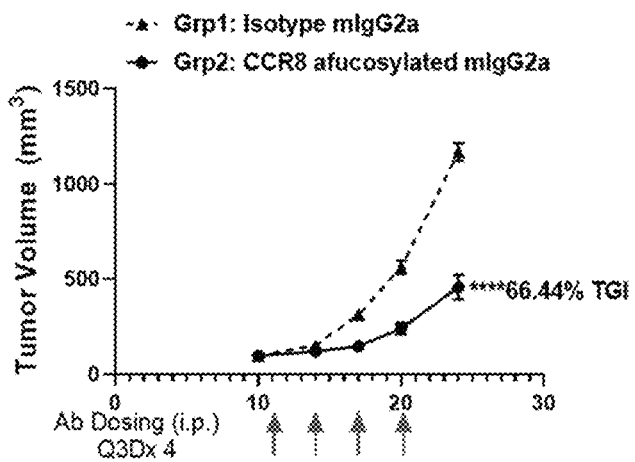
FIGS. 2A-2C. Anti-tumor activity of CCR8 afucosylated mIgG2a antibody in an MC38 syngeneic mouse model. Individual tumor growth for isotype control mIgG2a antibody (dashed lines) or CCR8 afucosylated mIgG2a antibody (solid lines) are shown in FIGS. 2C and 2B, respectively.
Figure 2B:
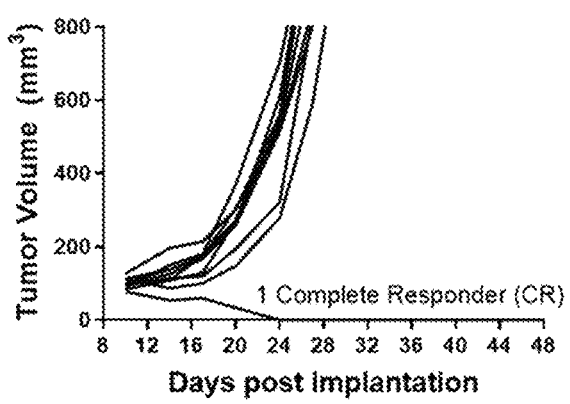
Figure 2C:
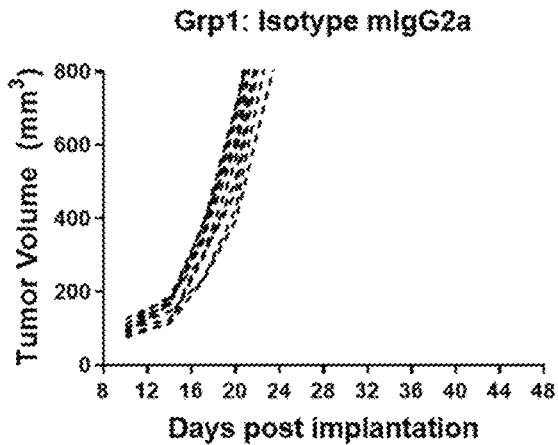

Individual tumor growth for the treatment groups is depicted as spider plots in FIGS. 2C and 2B. FIG. 2A demonstrates the mean tumor volume+/−SEM for each group until the last timepoint (day 24). Mice treated with the anti-CCR8 afucosylated mIgG2a antibody showed a statistically reduced tumor volume by day 24 compared to isotype control treated animals. There was one complete responder, as shown in FIG. 2B. This complete responder animal was assessed until day 48, at which time there was no measurable tumor. Animals with no measurable tumors defined as Complete Responders (CRs) were assessed until day 48. These data demonstrate that MC38 tumor-bearing animals showed a significant reduction in tumor volume when treated with an anti-CCR8 afucosylated mIgG2a antibody (66.44% TGI, ****p<0.0001) compared to isotype control.

Example 12: CCR8 Depleting Antibody Treatment Extends Survival In Vivo

MC38 tumor cells were implanted subcutaneously in the right flank of female hCD3eKI animals on study day 0. On day 10, tumors were assigned to different treatment groups (n=10/group) with an average tumor volume of 99.93 mm$^3$. Animals were dosed intra-peritoneally with 10 mg/kg of either isotype control mIgG2a or anti-CCR8 afucosylated mIgG2a antibody on study days 11, 14, 17 and 20 (Q3D×4). All animals were assessed until their tumors reached 800 mm$^3$ or according to IACUC standards of animal welfare. Statistical analysis was performed using the Log-rank (Mantel-Cox) test comparing anti-CCR8 afucosylated mIgG2a antibody (treatment Grp2) to isotype control mIgG2a (control Grp1). **** indicates p<0.0001.

Figure 3:
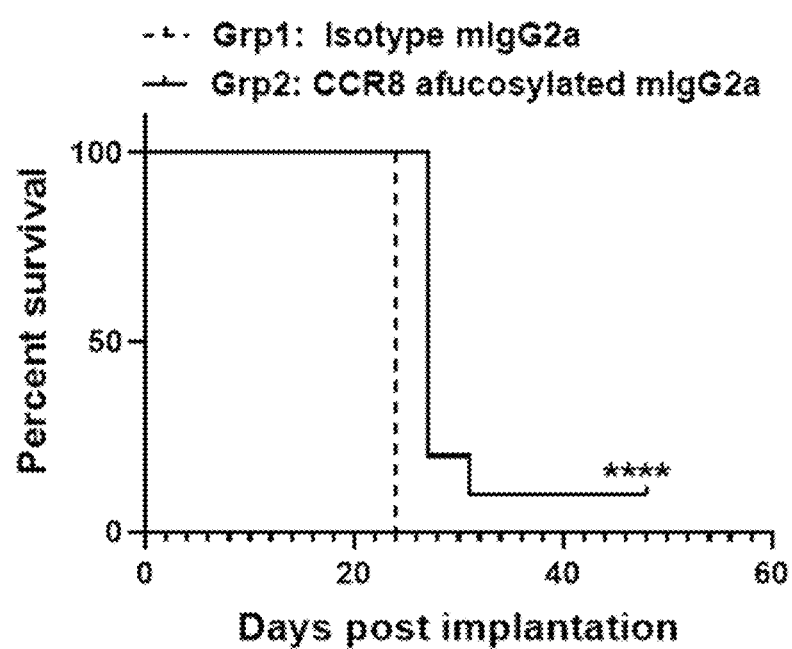
FIG. 3. Percent survival of mice inoculated with MC38 tumor cells and treated with either isotype control mIgG2a antibody (dashed lines) or CCR8 afucosylated mIgG2a antibody (solid lines). **** indicates p<0.0001.

Survival data is shown in FIG. 3. The median survival for isotype control mIgG2a treated animals was 24 days, whereas the median survival for anti-CCR8 afucosylated mIgG2a antibody treated animals was 27 days (****p<0.0001). These data demonstrate that MC38 tumor-bearing animals have increased survival when treated with an anti-CCR8 afucosylated mIgG2a antibody as compared to animals treated with an isotype control antibody.

Example 13: Treg Depletion with CCR8 mIgG2a Antibody Leads to Enhanced CD8+/Treg Ratio in Tumors MC38 tumor bearing animals were treated with a single 10 mg/kg dose of either control isotype mIgG2a or anti-CCR8 afucosylated mIgG2a intra-peritoneally on study day eleven. PD evaluation was performed at 48 hours post treatment (day 13). Tumor weights were collected during harvest for the different groups and used for normalization to determine absolute cell counts in tumors. Single cell suspensions of tumor, draining lymph node (DLN), and spleen were prepared for flow cytometry analysis of T cell proportions and phenotypes.

Total T cells were gated using TCRβ+Thy1.2+ staining within the Live/CD45+ fraction. Percentage and absolute numbers of Treg cells depicted in FIG. 4A were assessed within the CD4+ T cell compartment using both Foxp3+ and CD25+Foxp3+ gating. CD8+ T cells were gated on total T cells and CD8/Treg ratios in tumor were calculated as depicted in FIG. 4B. Each dot represents data obtained from an individual mouse. Statistical analysis was performed using Unpaired T-test (two-tailed) comparing treatment to control group (* p<0.05, ** p<0.01).

Figure 4A:
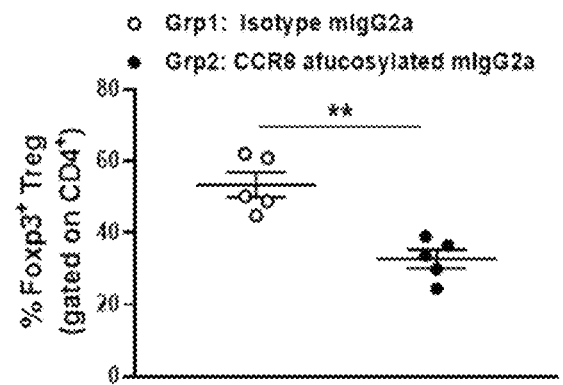
FIGS. 4A-4D. CD8+/Treg ratio in MC38 tumor-bearing mice treated with either isotype control mIgG2a antibody (•) or CCR8 afucosylated mIgG2a antibody (•).
Figure 4B:
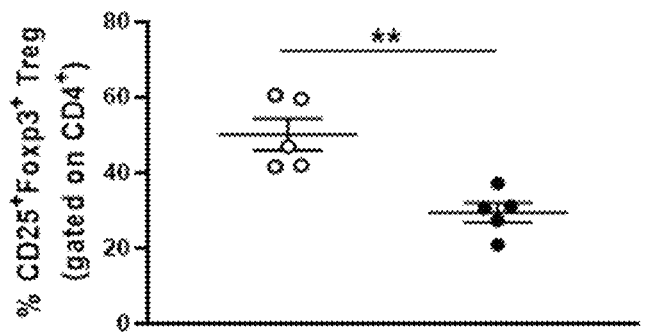
Figure 4C:
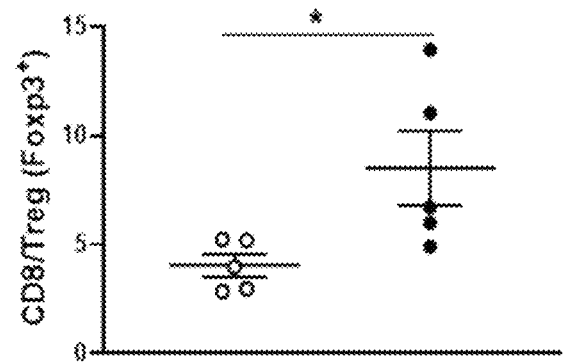
Figure 4D:
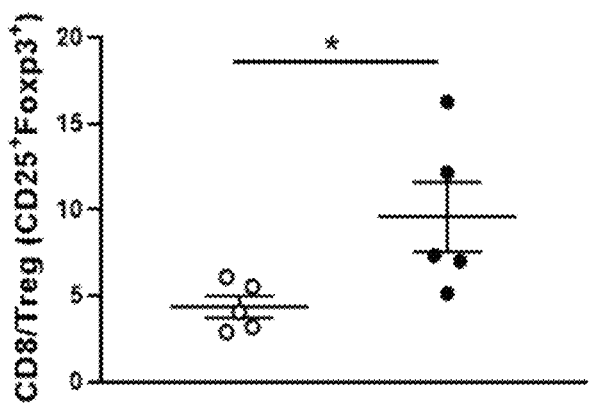

These data demonstrate a reduction in percent Tregs following a single dose of anti-CCR8 afucosylated antibody, as assessed using both Foxp3+ and CD25+Foxp3+ gating schemes (FIGS. 4A and 4B). Importantly, anti-CCR8 depleting antibody treatment resulted in significantly increased CD8+/Treg ratios in tumors (FIGS. 4C and 4D), thereby driving enhanced anti-tumor immunity.

Example 14: CCR8-Binding scFvs Screened by Phage Display

A preferred type of an amino acid substitutional variation of the CCR8-binding molecules described herein involves substituting one or more CDR residues of a parent antibody (e.g., a humanized or human antibody). Generally, the resulting variant(s) selected for further development will have improved biological properties relative to the parent antibody from which they are generated. One way for generating such substitutional variants involves affinity maturation using phage display. Briefly, several CDR sides (e.g., 6-7 sides) were mutated to generate all possible amino acid substitutions at each side. The antibody variants thus generated were displayed in a monovalent fashion from filamentous phage particles as fusions to, e.g., the gene III product of M13 packaged within each particle. The phage-displayed variants were then screened for their biological activity (e.g., binding affinity) as disclosed herein. In order to identify candidate CDR sides for modification, alanine scanning mutagenesis was performed to identify CDR residues contributing significantly to antigen binding.

Once such variants were generated, the panel of variants was subjected to screening as described herein and antibodies with superior properties in one or more relevant assays were selected for further development. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

Anti-CCR8 scFvs that bind in the 1-12 amino acid epitope (amino acid sequence given by SEQ ID NO: 82) were generated and screened for epitope binding by phage display essentially as described above. Heavy and light chain amino acid sequences of scFvs that bind CCR8 in the 1-12 amino acid epitope cluster are shown in Table 12.

TABLE 12

HCVR and LCVR amino acid
SEQ ID NOs of anti-CCR8 scFvs.

| scFv Molecule | HCVR Amino Acid SEQ ID NO | LCVR Amino Acid SEQ ID NO |
|---|---|---|
| MPK20298-A4_SCFV huCCR8 | 953 | 954 |
| MPK20299-D2_SCFV huCCR8 | 955 | 956 |
| MPK20299-F11_SCFV huCCR8 | 957 | 958 |
| MPK20298-H6_SCFV huCCR8 | 959 | 960 |
| MPK20297-A4_SCFV huCCR8 | 961 | 962 |
| MPK20299-H8_SCFV huCCR8 | 963 | 964 |
| MPK20300-C11_SCFV huCCR8 | 965 | 966 |
| MPK20298-B1_SCFV huCCR8 | 967 | 968 |
| MPK20297-E5_SCFV huCCR8 | 969 | 970 |
| MPK20299-A3_SCFV huCCR8 | 971 | 972 |
| MPK20297-B4_SCFV huCCR8 | 973 | 974 |
| MPK20298-F6_SCFV huCCR8 | 975 | 976 |
| MPK20299-H3_SCFV huCCR8 | 977 | 978 |
| MPK20298-B9_SCFV huCCR8 | 979 | 980 |
| MPK20299-E2_SCFV huCCR8 | 981 | 982 |
| MPK20299-D6_SCFV huCCR8 | 983 | 984 |
| MPK20299-A4_SCFV huCCR8 | 985 | 986 |
| MPK20300-G5_SCFV huCCR8 | 987 | 988 |
| MPK20299-C3_SCFV huCCR8 | 989 | 990 |
| MPK20299-B7_SCFV huCCR8 | 991 | 992 |
| MPK20299-A5_SCFV huCCR8 | 993 | 994 |
| MPK20299-D1_SCFV huCCR8 | 995 | 996 |
| MPK20299-C5_SCFV huCCR8 | 997 | 998 |
| MPK20299-B5_SCFV huCCR8 | 999 | 1000 |
| MPK20299-G9_SCFV huCCR8 | 1001 | 1002 |
| MPK20299-G5_SCFV huCCR8 | 1003 | 1004 |
| MPK20298-C10_SCFV huCCR8 | 1005 | 1006 |
| MPK20298-B5_SCFV huCCR8 | 1007 | 1008 |
| MPK20299-F2_SCFV huCCR8 | 1009 | 1010 |
| MPK20298-D4_SCFV huCCR8 | 1011 | 1012 |
| MPK20297-F5_SCFV huCCR8 | 1013 | 1014 |
| MPK20299-D9_SCFV huCCR8 | 1015 | 1016 |

The anti-CCR8 scFv MPK20299-A4 was further engineered and converted into afucosylated anti-CCR8 antibodies to generate additional anti-CCR8 antibodies that bind 1-12.

Example 15: Affinity of CCR8-Binding Antibodies to CCR8 Peptide-Nanobody Complexes Binding affinities ($K_D$ equilibrium dissociation constant) and rate constants ($k_a$ association rate constant, $k_d$ dissociation rate constant) of an Antibody 1 Fab and CCR8-binding monoclonal antibodies (mAbs) of the present invention to a CCR8 1-12 epitope (SEQ ID NO: 82)-nanobody (Nb) fusion protein were measured using an OCTET® Biolayer Interferometry system (Sartorius A G, Göttingen, Germany). The CCR8-nanobody fusion proteins were expressed in human cells. For Fab binding, biotinylated CCR8 peptide-Nb fusions were captured on streptavidin SAX biosensors to loading levels between 2 and 4 nm and then incubated with a dilution series of the soluble Fab (top 100 nM, 6-point, 1:3 serial dilution) for 300 seconds followed by 500 seconds in buffer for dissociation. For mAb binding, mAbs were captured on an anti-huIgG Fc capture biosensor to 1 to 2 nm loading level and then incubated with a dilution series of non-biotinylated CCR8 peptide-Nb fusions (top 100 nM, 6-point, 1:3 serial dilution) for 300 seconds followed by 500 seconds in buffer for dissociation.

The OCTET® system acquires data over time (seconds) using a mechanism called Biolayer Interferometry; as proteins bind to biosensor tips, a sensitive binding signal in nm is measured by the instrument. All fiber optic tips were used once and then discarded, i.e., no regeneration. OCTET® buffer baselines, dissociation steps, and protein dilutions were made with OCTET® buffer (10 mM TRIS pH 7.5, 150 mM NaCl, 1 mM $CaCl_2$), 0.13% (v/v) Triton X-100 and 0.10 mg/mL BSA).

Raw data was processed with GeneData Screener v18 SPR package which uses the same data processing as the OCTET® instrument Data Analysis software (subtract average of two reference wells per column; Align Y-axis to baseline; Interstep correction align to dissociation; and Savitzky-Golay filtering). Each Fab or mAb interaction was grouped into its own sensorgram and globally fit with a 1:1 binding model to determine the association rate constant ($k_a$; units $M^{-1}sec^{-1}$) and the dissociation rate constant ($k_d$; units $sec^{-1}$). The equilibrium dissociation constant ($K_D$; units nanomolar (nM)=$1\times10^{-9}$ mol/L) was then calculated as a ratio of $k_d/k_a$.

Results are shown in Table 13a and 13b. Errors in the 1:1 model fit to the processed data were reported as standard errors (i.e., $k_a$ error was the standard error of the association rate constant measurement while the $k_d$ error was the standard error of the dissociation rate constant measurement). The standard error of the equilibrium dissociation constant ($\Delta K_D$) is calculated from the statistical propagation of error as defined for the ratio of two measured variables and their standard errors ($k_a$, $\Delta k_a$, $k_d$, $\Delta k_d$).

TABLE 13a

Binding Affinities and Rate Constants of CCR8-Binding Antibodies to CCR8 Epitope-Nanobody Complexes (1-12).

| | huCCR8 (1-12)-Nb | | | | | | |
|---|---|---|---|---|---|---|---|
| CCR8 Fab & mAbs | $k_a$ ($M^{-1}s^{-1}$) | ka error | $k_d$ ($s^{-1}$) | kd error | $K_D$ (nM) | KD Error | isotype Nb |
| Fab (HCVR SEQ ID NO: 13; LCVR SEQ ID NO: 14) | 5.84E+05 | 6.19E+03 | 1.32E-02 | 9.20E-05 | 22.6 | 0.2 | no binding |
| huCCR8_44379 (VH: D61A_D72A, VL: N67Q_M99E_W109F_S111A)_ huIgG1z (mAb) (HC SEQ ID NO: 1239; LC SEQ ID NO: 1130) | 1.42E+05 | 1.05E+03 | 1.34E-03 | 1.15E-05 | 9.5 | 0.1 | no binding |

TABLE 13a-continued

Binding Affinities and Rate Constants of CCR8-Binding
Antibodies to CCR8 Epitope-Nanobody Complexes (1-12).

| | huCCR8 (1-12)-Nb | | | | | | |
|---|---|---|---|---|---|---|---|
| CCR8 Fab & mAbs | $k_a$ ($M^{-1}s^{-1}$) | ka error | $k_d$ ($s^{-1}$) | kd error | $K_D$ (nM) | KD Error | isotype Nb |
| huCCR8_44379 (VH: D61S, VL: N67Q_M99G_ W109F_S111A)_ huIgG1z (mAb) (HC SEQ ID NO: 1240; LC SEQ ID NO: 1132) | 1.32E+05 | 1.40E+03 | 1.07E-03 | 1.60E-05 | 8.1 | 0.2 | no binding |
| huCCR8_44379 (VH: D72S, VL: N67A_S68A_M99G_ W109F_S111A)_ huIgG1z (mAb) (HC SEQ ID NO: 1238; LC SEQ ID NO: 1128) | 1.22E+05 | 1.11E+03 | 1.10E-03 | 1.33E-05 | 9.0 | 0.1 | no binding |
| huCCR8 (32360LC: K38R)_ huIg1z (mAb) (HC SEQ ID NO: 1237; LC SEQ ID NO: 1126) | 3.97E+05 | 1.42E+04 | 2.40E-02 | 5.59E-04 | 60.6 | 2.1 | no binding |

TABLE 13b

Binding Affinities and Rate Constants of CCR8-Binding
Antibodies to CCR8 Epitope-Nanobody Complexes (1-25).

| | huCCR8 (1-25)[C25S]-Nb | | | | | | |
|---|---|---|---|---|---|---|---|
| CCR8 Fab & mAbs | $k_a$ ($M^{-1}s^{-1}$) | ka error | $k_d$ ($s^{-1}$) | kd error | $K_D$ (nM) | KD Error | isotype Nb |
| Fab (HCVR SEQ ID NO: 13; LCVR SEQ ID NO: 14) | 6.06E+05 | 5.75E+03 | 1.06E-02 | 6.36E-05 | 17.4 | 0.2 | no binding |
| huCCR8_44379 (VH: D61A_D72A, VL: N67Q_M99E_ W109F_S111A)_ huIgG1z (mAb) (HC SEQ ID NO: 1239; LC SEQ ID NO: 1130) | 1.46E+05 | 1.32E+03 | 1.14E-03 | 1.39E-05 | 7.8 | 0.1 | no binding |
| huCCR8_44379 (VH: D61S, VL: N67Q_M99G_ W109F_S111A)_ huIgG1z (mAb) (HC SEQ ID NO: 1240; LC SEQ ID NO: 1132) | 1.10E+05 | 1.18E+03 | 7.98E-04 | 1.53E-05 | 7.2 | 0.2 | no binding |
| huCCR8_44379 (VH: D72S, VL: N67A_S68A_M99G_ W109F_S111A)_ huIgG1z (mAb) (HC SEQ ID NO: 1238; LC SEQ ID NO: 1128) | 9.93E+04 | 9.76E+02 | 9.75E-04 | 1.37E-05 | 9.8 | 0.2 | no binding |
| huCCR8 (32360LC: K38R)_ huIgG1z (mAb) (HC SEQ ID NO: 1237; LC SEQ ID NO: 1126) | | | Biphasic Binding | | | | no binding |

These data demonstrate that CCR8-binding antibodies of the present invention bind to N-terminal peptides of human CCR8 containing amino acids 1-12 (SEQ ID NO: 82) and amino acids 1-25 (residues 1-25 of SEQ ID NO: 31), expressed in human cells, with high affinity.

Example 16: ADCC in the Presence or Absence of Ligand

To determine ADCC with anti-CCR8 antibodies that either block ligand binding or do not block ligand binding, flow cytometry was utilized to measure live and dead cells in the presence of varying concentrations of ligand and anti-CCR8 antibody. In an experiment ("Study A"), 100 pM of an afucosylated anti-CCR8 antibody of the present invention which binds a unique epitope and does not block ligand binding (antibody comprising HCDR1, HCDR2, HCDR3, LCDR1, LCDR2, and LCDR3 amino acid sequences of SEQ ID NOs 1-6, respectively; "Non-blocking mAb") or three anti-CCR8 antibodies that block ligand binding ("Blocking mAb") were incubated with HUT78 cells that express CCR8, NK cell line NK92MI expressing CD16 (effector cells), and increasing concentrations of CCL1 (ligand) from 0.128 pM to 50 nM. In another experiment ("Study B"), similar procedures were followed as described above except increasing concentrations of CCL1 was first added to the HUT78 cells for thirty minutes, followed by addition of 100 pM antibody and effector cells. $IC_{50}$ values and bottom % killing values are reported in Table 14.

Following procedures essentially as described, the following data were obtained.

TABLE 14

ADCC activity of blocking and non-blocking anti-CCR8 antibodies in the presence of CCL1.

| Antibody | Study A $IC_{50}$ (CCL1) nM | Study A Bottom % Killing | Study B $IC_{50}$ (CCL1) nM | Study B Bottom % Killing |
| --- | --- | --- | --- | --- |
| Non-blocking mAb | 0.34 | 19.6 | 1.0 | 12.9 |
| Blocking mAb 1 | 3.0 | −2.6 | 2.3 | −8.7 |
| Blocking mAb 2 | 1.0 | 4.3 | 1.1 | 7.0 |
| Blocking mAb 3 | 2.4 | 3.6 | 2.8 | 2.8 |
| huIgG1 control | N/A | −1.5 | N/A | 1.3 |

These data demonstrate in both Study A and Study B, in the presence of ligand, the anti-CCR8 antibody of the present invention that binds a unique epitope and does not block ligand binding had high potency and also demonstrated the highest Bottom % Killing, which measures the ADCC ability at high concentrations of CCL1.

Example 17: Anti-CCR8 and BiTE® Molecule Combination In Vivo

CCR8 depleting mouse surrogate antibody was evaluated in combination with surrogate TAA-BiTE molecule for its ability to enhance anti-tumor activity in the B16F10 tumor model. The B16F10 tumor model was chosen for this combination efficacy study since this model is refractory to checkpoint inhibitors (anti-PD1 and anti-CTLA4), and therefore can be used to assess meaningful differences with the combination therapy of BiTE molecule and anti-CCR8 mAb in this Example.

B16F10 tumor cells were engineered to express the BiTE molecule tumor-associated antigen (TAA) and implanted on the immunocompetent humanized CD3e KI strain that enables evaluation of TAA-BiTE molecules with an I2C anti-CD3 scFv recognizing human CD3e. B16F10-TAA tumor-bearing animals were treated with either single agents of CCR8 depleting mIgG2a antibody, TAA-BiTE molecule, or a combination of CCR8 depleting mIgG2a antibody and TAA-BiTE molecule.

B16F10-TAA expressing tumor cells were implanted subcutaneously in an immunocompetent mouse model expressing a humanized CD3e chain (huCD3e KI) on day 0. Tumors were assigned on day 12 into different treatment groups (n=10/group) with an average tumor volume of 108.37 mm3. Animals were dosed retro-orbitally with 50 µg/kg of either control BiTE molecule or TAA-BiTE on study days 13 and 20 (QWk×2). Animals also received 10 mg/kg of either control isotype mIgG2a or a CCR8 afucosylated mIgG2a antibody dosed intra-peritoneally on study days 13, 16, and 19 (Q3D×3).

Tumor volume was measured twice per week. Individual tumor growth for the treatment groups is depicted as spider plots in FIGS. 5A-5D. Animals with no measurable tumors defined as Complete Responders (CRs) have been assessed until day 48.

Figure 5A:
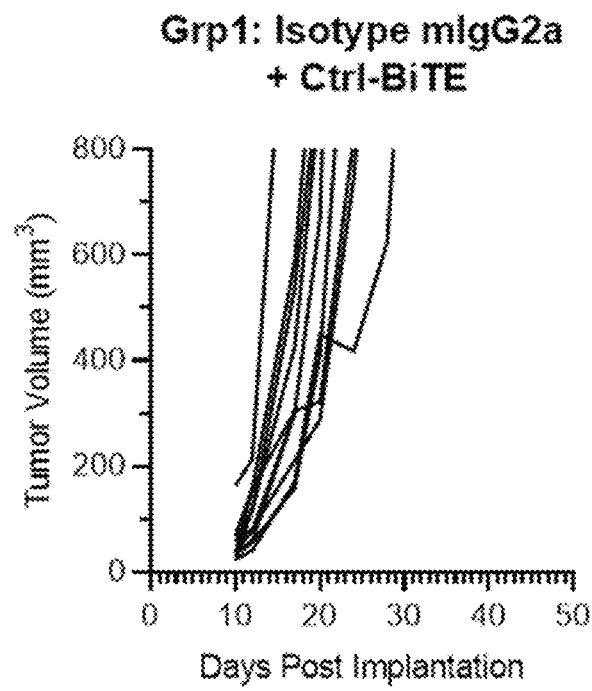
FIGS. 5A-5D. Anti-tumor activity of CCR8 afucosylated mIgG2a as monotherapy and in combination with TAA-BiTE molecule in the B16F10 syngeneic tumor model expressing tumor-associated antigen (TAA). Individual tumor growth for the treatment groups is depicted as spider plots (FIGS. 5A to 5D). Animals with no measurable tumors defined as Complete Responders (CRs) have been assessed until day 48.
Figure 5B:
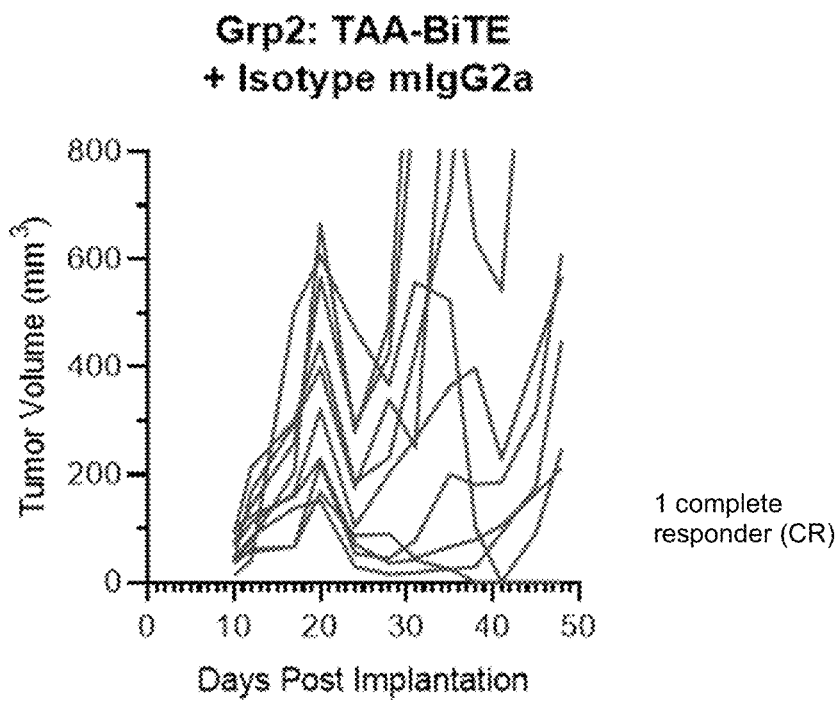
Figure 5C:
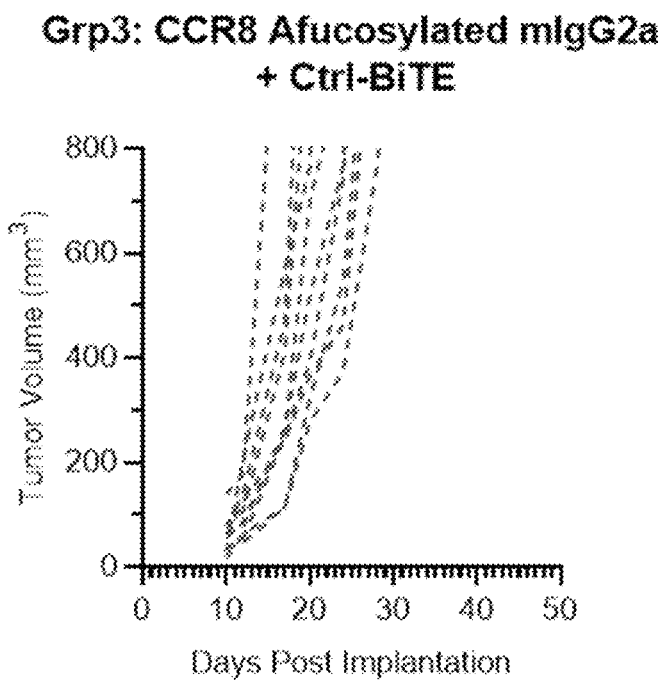
Figure 5D:
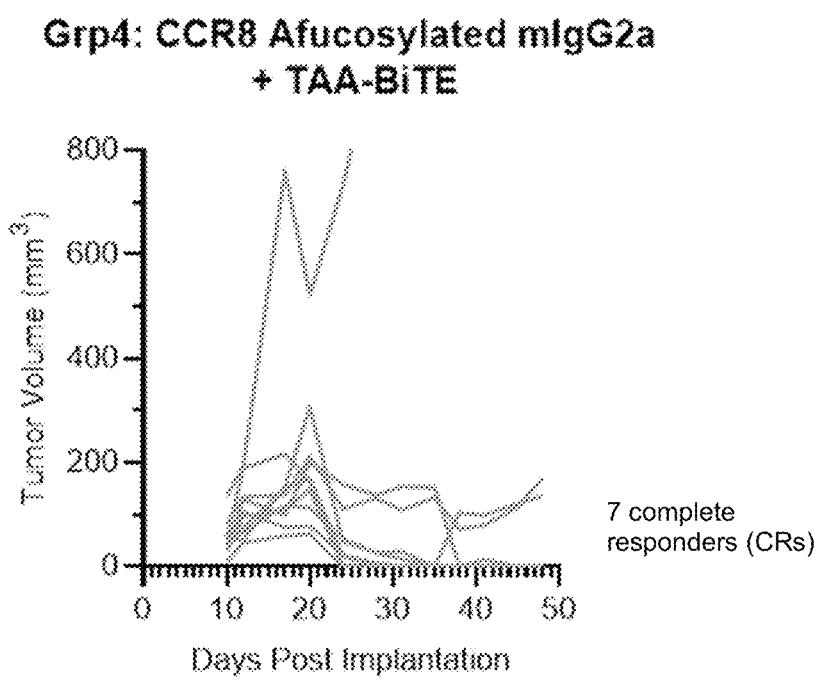

As shown in FIGS. 5A-5D, monotherapy of CCR8 mIgG2a (Grp3; FIG. 5C) was not efficacious in this cold tumor model refractory to anti-CTLA4. Monotherapy with TAA-BiTE (Grp2; FIG. 5B) led to tumor growth delay and 1 tumor-free/complete responder (CR) at end of the study. Interestingly, the combination of CCR8 mIgG2a and TAA-BiTE (Grp4; FIG. 5D) led to 7 CRs, demonstrating the significant benefit of combining CCR8 depleting mAbs with BiTE molecules to boost anti-tumor immunity.

| SEQUENCES |
| --- |
| Antibody 1 IgG2 HCDR1 (SEQ ID NO: 1) NARMG |
| Antibody 1 IgG2 HCDR2 (SEQ ID NO: 2) RIKSKTEGGTRDYAAPVKG |
| Antibody 1 IgG2 HCDR3 (SEQ ID NO: 3) YSGV |
| Antibody 1 IgG2 LCDR1 (SEQ ID NO: 4) KSSQSVLYSSNNKNYLA |
| Antibody 1 IgG2 LCDR2 (SEQ ID NO: 5) WASTRES |
| Antibody 1 IgG2 LCDR3 (SEQ ID NO: 6) QQYYSIPIT |
| Antibody 2 IgG2 HCDR1 (SEQ ID NO: 7) NYGMH |
| Antibody 2 IgG2 HCDR2 (SEQ ID NO: 8) VISYDGSNKFYADSVKG |

-continued

| SEQUENCES |
|---|

Antibody 2 IgG2 HCDR3 (SEQ ID NO: 9)
AGGIGRFDY

Antibody 2 IgG2 LCDR1 (SEQ ID NO: 10)
KYSQSLLHSDGKTYLF

Antibody 2 IgG2 LCDR2 (SEQ ID NO: 11)
EVSNRFS

Antibody 2 IgG2 LCDR3 (SEQ ID NO: 12)
MQTLKLPLT

Antibody 1 IgG2 HCVR (SEQ ID NO: 13)
EVQLVESGGGLVKPGGSLRLSCAASGFTFSNARMGWVRQAPGKGLEWVGRIKSKTE
GGTRDYAAPVKGRFTISRDDSKNTLYLQMNSLKTEDTAVYYCTSYSGVWGQGTMV
TVSS Antibody 1 IgG2 LCVR (SEQ ID NO: 14)
DIVMTQSPDSLAVSLGERATINCKSSQSVLYSSNNKNYLAWYHQKPGQSPKLLISWA
STRESGVPDRFSGSGSGTDFTLTINSLQAEDVAVYYCQQYYSIPITFGGGTKVEIKR Antibody 1 IgG2 HC (SEQ ID NO: 15)
EVQLVESGGGLVKPGGSLRLSCAASGFTFSNARMGWVRQAPGKGLEWVGRIKSKTE
GGTRDYAAPVKGRFTISRDDSKNTLYLQMNSLKTEDTAVYYCTSYSGVWGQGTMV
TVSSASTKGPSVFPLAPCSRSTSESTAALGCLVKDYFPEPVTVSWNSGALTSGVHTFP
AVLQSSGLYSLSSVVTVPSSNFGTQTYTCNVDHKPSNTKVDKTVERKCCVECPPCPA
PPVAGPSVFLFPPKPKDTLMISRTPEVTCVVVDVSHEDPEVQFNWYVDGVEVHNAKT
KPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGS
FFLYSKLTVDKSRWQQGNVFSCSVMHEALHNHYTQKSLSLSPGK Antibody 1 IgG2 LC (SEQ ID NO: 16)
DIVMTQSPDSLAVSLGERATINCKSSQSVLYSSNNKNYLAWYHQKPGQSPKLLISWA
STRESGVPDRFSGSGSGTDFTLTINSLQAEDVAVYYCQQYYSIPITFGGGTKVEIKRTV
AAPSVFIFPPSDEQLKSGTASVVCLLNNFYPREAKVQWKVDNALQSGNSQESVTEQD
SKDSTYSLSSTLTLSKADYEKHKVYACEVTHQGLSSPVTKSFNRGEC Antibody 2 IgG2 HCVR (SEQ ID NO: 17)
QVQLVESGGGVVQPGRSLRLSCAASGFTFSNYGMHWVRQAPGKGLEWVAVISYDG
SNKFYADSVKGRFTISRDNSKKTLYLQMSSLRVEDTAVYYCARAGGIGRFDYWGQG
TLVTVSS Antibody 2 IgG2 LCVR (SEQ ID NO: 18)
DFVMTQTPLSLSVTPGQPASISCKYSQSLLHSDGKTYLFWYLQKPGQPPHLLIYEVSN
RFSGVPDRFSGSGSGTDFTLKISRVEAEDVGLYYCMQTLKLPLTFGGGTKVEIN Antibody 2 IgG2 HC (SEQ ID NO: 19)
QVQLVESGGGVVQPGRSLRLSCAASGFTFSNYGMHWVRQAPGKGLEWVAVISYDG
SNKFYADSVKGRFTISRDNSKKTLYLQMSSLRVEDTAVYYCARAGGIGRFDYWGQG
TLVTVSSASTKGPSVFPLAPCSRSTSESTAALGCLVKDYFPEPVTVSWNSGALTSGVH
TFPAVLQSSGLYSLSSVVTVPSSNFGTQTYTCNVDHKPSNTKVDKTVERKCCVECPP
CPAPPVAGPSVFLFPPKPKDTLMISRTPEVTCVVVDVSHEDPEVQFNWYVDGVEVHN
AKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDS
DGSFFLYSKLTVDKSRWQQGNVFSCSVMHEALHNHYTQKSLSLSPGK Antibody 2 IgG2 LC (SEQ ID NO: 20)
DFVMTQTPLSLSVTPGQPASISCKYSQSLLHSDGKTYLFWYLQKPGQPPHLLIYEVSN
RFSGVPDRFSGSGSGTDFTLKISRVEAEDVGLYYCMQTLKLPLTFGGGTKVEINRTVA
APSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC hCCR8 (SEQ ID NO: 21)
MDYTLDLSVTTVTDYYYPDIFSSPCDAELIQTNGKLLLAVFYCLLFVFSLLGNSLVIL
VLVVCKKLRSITDVYLLNLALSDLLFVSFPPFQTYYLLDQWVFGTVMCKVVSGFYYI
GFYSSMFFITLMSVDRYLAVVHAVYALKVRTIRMGTTLCLAVWLTAIMATIPLLVFY
QVASEDGVLQCYSFYNQQTLKWKIFTNFKMNILGLLIPFTIFMFCYIKILHQLKRCQN
HNKTKAIRLVLIVVIASLLFWVPFNVVLFLTSLHSMHILDGCSISQQLTYATHVTEIISF
THCCVNPVIYAFVGEKFKKHLSEIFQKSCSQIFNYLGRQMPRESCEKSSSCQQHSSRSS
SVDYIL Cyno CCR8 (SEQ ID NO: 22)
MDYTLDPSMTTMTDYYYPDSLSSPCDGELIQRNDKLLLAVFYCLLFVFSLLGNSLVIL
VLVVCKKLRNITDIYLLNLALSDLLFVSFPPFQTYYQLDQWVFGTVMCKVVSGFYYI
GFYSSMFFITLMSVDRYLAVVHAVYAIKVRTIRMGTTLSLVVWLTAIMATIPLLVFY
QVASEDGVLQCYSFYNQQTLKWKIFTNFEMNILGLLIPFTIFMFCYIKILHQLKRCQN HNKTKAIRLVLIVVIASLLFWVPFNVVLFLTSLHSMHILDGCSISQQLNYATHVTEIISF
THCCVNPVIYAFVGEKFKKHLSEIFQKSCSHIFIYLGRQMPRESCEKSSSCQQHSFRSS
SIDYIL humanCCR8[A27G] (SEQ ID NO: 23)
MDYTLDLSVTTVTDYYYPDIFSSPCDGELIQTNGKLLLAVFYCLLFVFSLLGNSLVIL
VLVVCKKLRSITDVYLLNLALSDLLFVFSFPPFQTYYLLDQWVFGTVMCKVVSGFYYI
GFYSSMFFITLMSVDRYLAVVHAVYALKVRTIRMGTTLCLAVWLTAIMATIPLLVFY
QVASEDGVLQCYSFYNQQTLKWKIFTNFKMNILGLLIPFTIFMFCYIKILHQLKRCQN
HNKTKAIRLVLIVVIASLLFWVPFNVVLFLTSLHSMHILDGCSISQQLTYATHVTEIISF
THCCVNPVIYAFVGEKFKKHLSEIFQKSCSQIFNYLGRQMPRESCEKSSSCQQHSSRSS
SVDYIL mCCR8 (SEQ ID NO: 24)
MDYTMEPNVTMTDYYPDFFTAPCDAEFLLRGSMLYLAILYCVLFVLGLLGNSLVILV
LVGCKKLRSITDIYLLNLAASDLLFVLSIPFQTHNLLDQWVFGTAMCKVVSGLYYIGF
FSSMFFITLMSVDRYLAIVHAVYAIKVRTASVGTALSLTVWLAAVTATIPLMVFYQV
ASEDGMLQCFQFYEEQSLRWKLFTHFEINALGLLLPFAILLFCYVRILQQLRGCLNHN
RTRAIKLVLTVVIVSLLFWVPFNVALFLTSLHDLHILDGCATRQRLALAIHVTEVISFT
HCCVNPVIYAFIGEKFKKHLMDVFQKSCSHIFLYLGRQMPVGALERQLSSNQRSSHSS
TLDDIL Rat CCR8 (SEQ ID NO: 25)
MDYTLEPNVTMTDYYPDFFTTPCDTELLLRGGTLYLAVLYCILFVLGLLGNSLVILVL
VACCKKLRSITDVYLLNLAASDLLFVLSIPFQTHNLLDQWVFGTVMCKVVSGLYYIGF
FSSMLFITLMSVDRYLAVVHPVHAIKVRTARVGTALSLAVWLAAIAATVPLMVFYQ
VSSEDGMLQCFQLYDEQSLRWKLFTHFEVNALGLLLPFAILLFCYVRILQQLRGCLN
HNRTRAIKLVLTIVVVSLLFWVPFNVVLFLTSLHDMHILEGCATRQRLALATHVTEVI
SFMHCCVNPVIYAFIGEKFKKHLVDVFQKSCSHIFLYVGRQMPVGALERQLSSNQRS
SHSSTLDYIL hCCR4 (SEQ ID NO: 26)
MNPTDIADTTLDESIYSNYYLYESIPKPCTKEGIKAFGELFLPPLYSLVFVFGLLGNSV
VVLVLFKYKRLRSMTDVYLLNLAISDLLFVFSLPFWGYYAADQWVFGLGLCKMISW
MYLVGFYSGIFFVMLMSIDRYLAIVHAVFSLRARTLTYGVITSLATWSVAVFASLPGF
LFSTCYTERNHTYCKTKYSLNSTTWKVLSSLEINILGLVIPLGIMLFCYSMIIRTLQHC
KNEKKNKAVKMIFAVVVLFLGFWTPYNIVLFLETLVELEVLQDCTFERYLDYAIQAT
ETLAFVHCCLNPIIYFFLGEKFRKYILQLFKTCRGLFVLCQYCGLLQIYSADTPSSSYT
QSTMDHDLHDAL Antibody 1 IgG2 HC DNA (SEQ ID NO: 27)
GAGGTGCAGCTGGTGGAGTCTGGGGGAGGCTTGGTAAAGCCTGGGGGGTCCCTG
AGACTCTCCTGTGCAGCCTCTGGATTTACTTTCAGTAACGCCCGGATGGCTGGG
TCCGCCAGGCTCCAGGGAAGGGGCTGGAGTGGGTTGGCCGTATTAAAAGCAAAA
CTGAAGGTGGGACAAGAGACTACGCTGCACCCGTGAAAGGCAGATTCACCATCT
CAAGAGATGATTCAAAAAACACGCTGTATCTGCAAATGAACAGCCTGAAAACCG
AGGACACAGCCGTGTATTATTGTACCTCGTATAGTGGGGTCTGGGGCCAAGGGA
CAATGGTCACCGTCTCTTCAGCCTCCACCAAGGGCCCATCGGTCTTCCCCCTGGC
GCCCTGCTCCAGGAGCACCTCCGAGAGCACAGCGGCCCTGGGCTGCCTGGTCAA
GGACTACTTCCCCGAACCGGTGACGGTGTCGTGGAACTCAGGCGCTCTGACCAGC
GGCGTGCACACCTTCCCAGCTGTCCTACAGTCCTCAGGACTCTACTCCCTCAGCA
GCGTGGTGACCGTGCCCTCCAGCAACTTCGGCACCCAGACCTACACCTGCAACGT
AGATCACAAGCCCAGCAACACCAAGGTGGACAAGACAGTTGAGCGCAAATGTTG
TGTCGAGTGCCCACCGTGCCCAGCACCACCTGTGGCAGGACCGTCAGTCTTCCTC
TTCCCCCCAAAACCCAAGGACACCCTCATGATCTCCCGGACCCCTGAGGTCACGT
GCGTGGTGGTGGACGTGAGCCACGAAGACCCCGAGGTCCAGTTCAACTGGTACG
TGGACGGCGTGGAGGTGCATAATGCCAAGACAAAGCCACGGGAGGAGCAGTTCA
ACAGCACGTTCCGTGTGGTCAGCGTCCTCACCGTTGTGCACCAGGACTGGCTGAA
CGGCAAGGAGTACAAGTGCAAGGTCTCCAACAAAGGCCTCCCAGCCCCCATCGA
GAAAACCATCTCCAAAACCAAAGGGCAGCCCCGAGAACCACAGGTGTACACCCT
GCCCCCATCCCGGGAGGAGATGACCAAGAACCAGGTCAGCCTGACCTGCCTGGT
CAAAGGCTTCTACCCCAGCGACATCGCCGTGGAGTGGGAGAGCAATGGGCAGCC
GGAGAACAACTACAAGACCACACCTCCCATGCTGGACTCCGACGGCTCCTTCTTC
CTCTACAGCAAGCTCACCGTGGACAAGAGCAGGTGGCAGCAGGGGAACGTCTTC
TCATGCTCCGTGATGCATGAGGCTCTGCACAACCACTACACGCAGAAGAGCCTCT
CCCTGTCTCCGGGTAAATAG Antibody 1 IgG2 LC DNA (SEQ ID NO: 28)
GACATCGTGATGACCCAGTCTCCAGACTCCCTGGCTGTGTCTCTGGGCGAGAG
GGCCACCATCAACTGCAAGTCCAGCCAGAGTGTTTTATACAGTTCCAACAATA
AGAACTACTTAGCTTGGTACCATCAGAAACCAGGACAGTCTCCTAAGCTGCTC
ATTTCCTGGGCATCTACCCGGGAATCCGGGGTCCCTGACCGATTCAGTGGCAG
CGGGTCTGGGACAGATTTCACTCTCACCATCAACAGCCTGCAGGCTGAAGATG
TGGCAGTTTATTACTGTCAACAATATTATAGTATTCCGATCACTTTCGGCGGAG
GGACCAAGGTGGAGATCAAACGA

SEQUENCES

Antibody 2 IgG2 HC DNA (SEQ ID NO: 29)
CAGGTGCAGTTGGTGGAGTCTGGGGGAGGCGTGGTCCAGCCTGGGAGGTCCCTG
AGACTCTCCTGTGCAGCCTCTGGATTCACCTTCAGTAACTATGGCATGCACTGGG
TCCGCCAGGCTCCAGGCAAGGGGCTGGAGTGGGTGGCAGTCATATCATATGATG
GAAGTAATAAATTCTATGCAGACTCCGTGAAGGGCCGATTCACCATCTCCAGAG
ACAATTCCAAGAAGACTCTGTATCTTCAAATGAGCAGCCTGAGAGTTGAGGACA
CGGCTGTATATTATTGTGCGAGAGCCGGGGGTATAGGGCGTTTTGACTACTGGGG
CCAGGGAACCCTGGTCACCGTCTCCTCAGCCTCCACCAAGGGCCCATCGGTCTTC
CCCCTGGCGCCCTGCTCCAGGAGCACCTCCGAGAGCACAGCGGCCCTGGGCTGC
CTGGTCAAGGACTACTTCCCCGAACCGGTGACGGTGTCGTGGAACTCAGGCGCTC
TGACCAGCGGCGTGCACACCTTCCCAGCTGTCCTACAGTCCTCAGGACTCTACTC
CCTCAGCAGCGTGGTGACCGTGCCCTCCAGCAACTTCGGCACCCAGACCTACACC
TGCAACGTAGATCACAAGCCCAGCAACACCAAGGTGGACAAGACAGTTGAGCGC
AAATGTTGTGTCGAGTGCCCACCGTGCCCAGCACCACCTGTGGCAGGACCGTCAG
TCTTCCTCTTCCCCCCAAAACCCAAGGACACCCTCATGATCTCCCGGACCCCTGA
GGTCACGTGCGTGGTGGTGGACGTGAGCCACGAAGACCCCGAGGTCCAGTTCAA
CTGGTACGTGGACGGCGTGGAGGTGCATAATGCCAAGACAAAGCCACGGGAGGA
GCAGTTCAACAGCACGTTCCGTGTGGTCAGCGTCCTCACCGTTGTGCACCAGGAC
TGGCTGAACGGCAAGGAGTACAAGTGCAAGGTCTCCAACAAAGGCCTCCCAGCC
CCCATCGAGAAAACCATCTCCAAAACCAAAGGGCAGCCCCGAGAACCACAGGTG
TACACCCTGCCCCCATCCCGGGAGGAGATGACCAAGAACCAGGTCAGCCTGACC
TGCCTGGTCAAAGGCTTCTACCCCAGCGACATCGCCGTGGAGTGGGAGAGCAAT
GGGCAGCCGGAGAACAACTACAAGACCACACCTCCCATGCTGGACTCCGACGGC
TCCTTCTTCCTCTACAGCAAGCTCACCGTGGACAAGAGCAGGTGGCAGCAGGGG
AACGTCTTCTCATGCTCCGTGATGCATGAGGCTCTGCACAACCACTACACGCAGA
AGAGCCTCTCCCTGTCTCCGGGTAAATAG Antibody 2 IgG2 LC DNA (SEQ ID NO: 30)
GATTTTGTAATGACCCAGACTCCACTCTCTCTGTCCGTCACCCCTGGACAGCCGG
CCTCCATCTCCTGCAAGTATAGTCAGAGCCTCCTGCACAGTGATGGAAAGACCTA
TTTGTTTTGGTACCTGCAGAAGCCAGGCCAGCCTCCACACCTCCTGATCTATGAA
GTTTCCAACCGGTTCTCTGGAGTGCCAGATAGGTTCAGTGGCAGCGGGTCAGGGA
CAGATTTCACACTGAAGATCAGCCGGGTGGAGGCTGAGGATGTTGGGCTTTATTA
CTGCATGCAAACTTTAAAGCTTCCGCTCACTTTCGGCGGAGGGACCAAGGTGGAG
ATCAACCGA Human CCR8 1-35 (SEQ ID NO: 31)
MDYTLDLSVTTVTDYYYPDIFSSPCDAELIQTNGK zeluvalimab LCDR1 (SEQ ID NO: 32)
RASQGISNWLA zeluvalimab LCDR2 (SEQ ID NO: 33)
AASSLQS zeluvalimab LCDR3 (SEQ ID NO: 34)
QQAESFPHT zeluvalimab HCDR1 (SEQ ID NO: 35)
SYDMS zeluvalimab HCDR2 (SEQ ID NO: 36)
LISGGGSQTYYAESVKG zeluvalimab HCDR3 (SEQ ID NO: 37)
PSGHYFYAMDV zeluvalimab VL (SEQ ID NO: 38)
DIQMTQSPSSVSASVGDRVTITCRASQGISNWLAWYQQKPGKAPKLLIFAASSLQSG
VPSRFSGSGSGTDFTLTISSLQPEDFATYYCQQAESFPHTFGGGTKVEIK zeluvalimab VH (SEQ ID NO: 39)
EVQLLESGGGLVQPGGSLRLSCAASGFTFSSYDMSWVRQAPGKGLEWVSLISGGGS
QTYYAESVKGRFTISRDNSKNTLYLQMNSLRAEDTAVYFCASPSGHYFYAMDVWG
QGTTVTSS zeluvalimab LC (SEQ ID NO: 40)
DIQMTQSPSSVSASVGDRVTITCRASQGISNWLAWYQQKPGKAPKLLIFAASSLQSG
VPSRFSGSGSGTDFTLTISSLQPEDFATYYCQQAESFPHTFGGGTKVEIKRTVAAPSVF
IFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC zeluvalimab HC (SEQ ID NO: 41)
EVQLLESGGGLVQPGGSLRLSCAASGFTFSSYDMSWVRQAPGKGLEWVSLISGGGS
QTYYAESVKGRFTISRDNSKNTLYLQMNSLRAEDTAVYFCASPSGHYFYAMDVWG
QGTTVTSSASTKGPSVFPLAPSSKSTSGGTAALGCLVKDYFPEPVTVSWNSGALTSG -continued

| SEQUENCES |
|---|

```
VHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVD
GVEVHNAKTKPCEEQYGSTYRCVSVLTVLHQDWLNGKEYKCKVSNKALPAPIEKTI
SKAKGQPREPQVYTLPPSREEMTKNQVSLTCLVKGFYPSDIAVEWESNGQPENNYKT
TPPVLDSDGSFFLYSKLTVDKSRWQQGNVFSCSVMHEALHNHYTQKSLSLSPGK

Antibody 20A2.003 LCDR1 (SEQ ID NO: 42)
SGDKLGDKYAS

Antibody 20A2.003 LCDR2 (SEQ ID NO: 43)
QDRKRPS

Antibody 20A2.003 LCDR3 (SEQ ID NO: 44)
QAFESSTEV

Antibody 20A2.003 HCDR1 (SEQ ID NO: 45)
NYGMH

Antibody 20A2.003 HCDR2 (SEQ ID NO: 46)
LIWYDASKKYYAESVKG

Antibody 20A2.003 HCDR3 (SEQ ID NO: 47)
DPSSLTGSTGYYGMDV

Antibody 20A2.003 VL (SEQ ID NO: 48)
SYELTQPPSVSVSPGQTASITCSGDKLGDKYASWYQQKPGQSPVLVIYQDRKRPSGIP
ERFSGSNSGNTATLTISGTQAMDEADYYCQAFESSTEVFGGGTKLTVL Antibody 20A2.003 VH (SEQ ID NO: 49)
QVQLVESGGGVVQPGRSLRLSCAASGFTFSNYGMHWVRQAPGKGLEWVALIWYDA
SKKYYAESVKGRFTISRDNSKNTLYLQMNSLRAEDTAAYYCARDPSSLTGSTGYYG
MDVWGQGTTVTVSS Antibody 20A2.003 LC (SEQ ID NO: 50)
SYELTQPPSVSVSPGQTASITCSGDKLGDKYASWYQQKPGQSPVLVIYQDRKRPSGIP
ERFSGSNSGNTATLTISGTQAMDEADYYCQAFESSTEVFGGGTKLTVLGQPKAAPSV
TLFPPSSEELQANKATLVCLISDFYPGAVTVAWKADSSPVKAGVETTTPSKQSNNKY
AASSYLSLTPEQWKSHRSYSCQVTHEGSTVEKTVAPTECS Antibody 20A2.003 HC (SEQ ID NO: 51)
QVQLVESGGGVVQPGRSLRLSCAASGFTFSNYGMHWVRQAPGKGLEWVALIWYDA
SKKYYAESVKGRFTISRDNSKNTLYLQMNSLRAEDTAAYYCARDPSSLTGSTGYYG
MDVWGQGTTVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEP
KSCDKTHTCPPCPAPELLGGPSVFLFPPKPKDTLMISRTPEVTCVVVDVSHEDPEVKF
NWYVDGVEVHNAKTKPCEEQYGSTYRCVSVLTVLHQDWLNGKEYKCKVSNKALP
APIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSL
SPGK Antibody 22D4.006 LCDR1 (SEQ ID NO: 52)
SGDALPKKYAY Antibody 22D4.006 LCDR2 (SEQ ID NO: 53)
EDAKRPS Antibody 22D4.006 LCDR3 (SEQ ID NO: 54)
YSTDASGNHRV Antibody 22D4.006 HCDR1 (SEQ ID NO: 55)
DYSMS Antibody 22D4.006 HCDR2 (SEQ ID NO: 56)
GINWNGGRTRYADAVKG Antibody 22D4.006 HCDR3 (SEQ ID NO: 57)
EFNNFESNWFDP Antibody 22D4.006 VL (SEQ ID NO: 58)
SYELTQPPSVSVSPGQTARITCSGDALPKKYAYWYQQKPGQAPVLVISEDAKRPSGIP
ERFSGSSSGTMATLTISGAQVEDEADYYCYSTDASGNHRVFGGGTKLTVL Antibody 22D4.006 VH (SEQ ID NO: 59)
EVQLVESGGSVVRPGGSLRLSCAASGFTVDDYSMSWVRQVPGKGLEWVSGINWNG
GRTRYADAVKGRFTISRDSAKNSLYLQMNSLRAEDTALYYCAREFNNFESNWFDPW
GQGTLVTVSS
```

SEQUENCES

Antibody 22D4.006 LC (SEQ ID NO: 60)
SYELTQPPSVSVSPGQTARITCSGDALPKKYAYWYQQKPGQAPVLVISEDAKRPSGIP
ERFSGSSSGTMATLTISGAQVEDEADYYCYSTDASGNHRVFGGGTKLTVLGQPKAAP
SVTLFPPSSEELQANKATLVCLISDFYPGAVTVAWKADSSPVKAGVETTTPSKQSNN
KYAASSYLSLTPEQWKSHRSYSCQVTHEGSTVEKTVAPTECS Antibody 22D4.006 HC (SEQ ID NO: 61)
EVQLVESGGSVVRPGGSLRLSCAASGFTVDDYSMSWVRQVPGKGLEWVSGINWNG
GRTRYADAVKGRFTISRDAKNSLYLQMNSLRAEDTALYYCAREFNNFESNWFDPW
GQGTLVTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSCDK
THTCPPCPAPELLGGPSVFLFPPKPKDTLMISRTPEVTCVVVDVSHEDPEVKFNWYVD
GVEVHNAKTKPCEEQYGSTYRCVSVLTVLHQDWLNGKEYKCKVSNKALPAPIEKTI
SKAKGQPREPQVYTLPPSREEMTKNQVSLTCLVKGFYPSDIAVEWESNGQPENNYKT
TPPVLDSDGSFFLYSKLTVDKSRWQQGNVFSCSVMHEALHNHYTQKSLSLSPGK Antibody 22D4.017 LCDR1 (SEQ ID NO: 62)
SGDALPKKYAY Antibody 22D4.017 LCDR2 (SEQ ID NO: 63)
EDAKRPS Antibody 22D4.017 LCDR3 (SEQ ID NO: 64)
YSTDASGNHRV Antibody 22D4.017 HCDR1 (SEQ ID NO: 65)
DYSMS Antibody 22D4.017 HCDR2 (SEQ ID NO: 66)
GINWNAGRTRYADAVKG Antibody 22D4.017 HCDR3 (SEQ ID NO: 67)
EFNNFESNWFDP Antibody 22D4.017 VL (SEQ ID NO: 68)
SYELTQPPSVSVSPGQTARITCSGDALPKKYAYWYQQKPGQAPVLVISEDAKRPSGIP
ERFSGSSSGTMATLTISGAQVEDEADYYCYSTDASGNHRVFGGGTKLTVL Antibody 22D4.017 VH (SEQ ID NO: 69)
EVQLVESGGSVVRPGGSLRLSCAASGFTVDDYSMSWVRQVPGKGLEWVSGINWNA
GRTRYADAVKGRFTISRDAKNSLYLQMNSLRAEDTALYYCAREFNNFESNWFDPW
GQGTLVTVSS Antibody 22D4.017 LC (SEQ ID NO: 70)
SYELTQPPSVSVSPGQTARITCSGDALPKKYAYWYQQKPGQAPVLVISEDAKRPSGIP
ERFSGSSSGTMATLTISGAQVEDEADYYCYSTDASGNHRVFGGGTKLTVLGQPKAAP
SVTLFPPSSEELQANKATLVCLISDFYPGAVTVAWKADSSPVKAGVETTTPSKQSNN
KYAASSYLSLTPEQWKSHRSYSCQVTHEGSTVEKTVAPTECS Antibody 22D4.017 HC (SEQ ID NO: 71)
EVQLVESGGSVVRPGGSLRLSCAASGFTVDDYSMSWVRQVPGKGLEWVSGINWNA
GRTRYADAVKGRFTISRDAKNSLYLQMNSLRAEDTALYYCAREFNNFESNWFDPW
GQGTLVTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSCDK
THTCPPCPAPELLGGPSVFLFPPKPKDTLMISRTPEVTCVVVDVSHEDPEVKFNWYVD
GVEVHNAKTKPCEEQYGSTYRCVSVLTVLHQDWLNGKEYKCKVSNKALPAPIEKTI
SKAKGQPREPQVYTLPPSREEMTKNQVSLTCLVKGFYPSDIAVEWESNGQPENNYKT
TPPVLDSDGSFFLYSKLTVDKSRWQQGNVFSCSVMHEALHNHYTQKSLSLSPGK Antibody 20C1.006 LCDR1 (SEQ ID NO: 72)
RASQGISNWLA Antibody 20C1.006 LCDR2 (SEQ ID NO: 73)
AASSLQS Antibody 20C1.006 LCDR3 (SEQ ID NO: 74)
QQAESFPHT Antibody 20C1.006 HCDR1 (SEQ ID NO: 75)
SYDMS Antibody 20C1.006 HCDR2 (SEQ ID NO: 76)
LISGGGSNTYYAESVKG Antibody 20C1.006 HCDR3 (SEQ ID NO: 77)
PSGHYFYAMDV

SEQUENCES

Antibody 20C1.006 VL (SEQ ID NO: 78)
DIQMTQSPSSVSASVGDRVTITCRASQGISNWLAWYQQKPGKAPKLLIFAASSLQSG
VPSRFSGSGSGTDFTLTISSLQPEDFATYYCQQAESFPHTFGGGTKVEIK Antibody 20C1.006 VH (SEQ ID NO: 79)
EVQLLESGGGLVQPGGSLRLSCAASGFTFSSYDMSWVRQAPGKGLEWVSLISGGGS
NTYYAESVKGRFTISRDNSKNTLYLQMNSLRAEDTAVYFCASPSGHYFYAMDVWG
QGTTVTVSS Antibody 20C1.006 LC (SEQ ID NO: 80)
DIQMTQSPSSVSASVGDRVTITCRASQGISNWLAWYQQKPGKAPKLLIFAASSLQSG
VPSRFSGSGSGTDFTLTISSLQPEDFATYYCQQAESFPHTFGGGTKVEIKRTVAAPSVF
IFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC Antibody 20C1.006 HC (SEQ ID NO: 81)
EVQLLESGGGLVQPGGSLRLSCAASGFTFSSYDMSWVRQAPGKGLEWVSLISGGGS
NTYYAESVKGRFTISRDNSKNTLYLQMNSLRAEDTAVYFCASPSGHYFYAMDVWG
QGTTVTVSSASTKGPSVFPLAPSSKSTSGGTAALGCLVKDYFPEPVTVSWNSGALTSG
VHTFPAVLQSSGLYSLSSVVTVPSSSLGTQTYICNVNHKPSNTKVDKKVEPKSCDKT
HTCPPCPAPELLGGPSVFLFPPKPKDTLMISRTPEVTCVVVDVSHEDPEVKFNWYVD
GVEVHNAKTKPCEEQYGSTYRCVSVLTVLHQDWLNGKEYKCKVSNKALPAPIEKTI
SKAKGQPREPQVYTLPPSREEMTKNQVSLTCLVKGFYPSDIAVEWESNGQPENNYKT
TPPVLDSDGSFFLYSKLTVDKSRWQQGNVFSCSVMHEALHNHYTQKSLSLSPGK CCR8 P_1-12 peptide (SEQ ID NO: 82)
MDYTLDLSVTTV CCR8 P_13-24 peptide (SEQ ID NO: 83)
TDYYYPDIFSSP CCR8 P_25-35 peptide (SEQ ID NO: 84)
CDAELIQTNGK CCR8 P_7-18 peptide (SEQ ID NO: 85)
LSVTTVTDYYYP CCR8 P_19-30 peptide (SEQ ID NO: 86)
DIFSSPCDAELI

TABLE 15

BiTE Molecule Sequences.

| | DESCRIPTION | SEQUENCE |
|---|---|---|
| | CD3 BINDING DOMAIN (I2C) | |
| 87 | Anti-CD3 CDR-L1 (I2C) | GSSTGAVTSGNYPN |
| 88 | Anti-CD3 CDR-L2 (I2C) | GTKFLAP |
| 89 | Anti-CD3 CDR-L3 (I2C) | VLWYSNRWV |
| 90 | Anti-CD3 CDR-H1 (I2C) | KYAMN |
| 91 | Anti-CD3 CDR-H2 (I2C) | RIRSKYNNYATYYADSVKD |
| 92 | Anti-CD3 CDR-H3 (I2C) | HGNFGNSYISYWAY |
| 93 | Anti-CD3 VH (I2C) | EVQLVESGGGLVQPGGSLKLSCAASGFTFNKYAMNWV RQAPGKGLEWVARIRSKYNNYATYYADSVKDRFTISRD DSKNTAYLQMNNLKTEDTAVYYCVRHGNFGNSYISYW AYWGQGTLVTVSS |
| 94 | Anti-CD3 VL (I2C) | QTVVTQEPSLTVSPGGTVTLTCGSSTGAVTSGNYPNWV QQKPGQAPRGLIGGTKFLAPGTPARFSGSLLGGKAALTL SGVQPEDEAEYYCVLWYSNRWVFGGGTKLTVL |
| 95 | Anti-CD3 VH-VL (I2C) | EVQLVESGGGLVQPGGSLKLSCAASGFTFNKYAMNWV RQAPGKGLEWVARIRSKYNNYATYYADSVKDRFTISRD DSKNTAYLQMNNLKTEDTAVYYCVRHGNFGNSYISYW AYWGQGTLVTVSSGGGGSGGGGSGGGGSQTVVTQEPS LTVSPGGTVTLTCGSSTGAVTSGNYPNWVQQKPGQAPR GLIGGTKFLAPGTPARFSGSLLGGKAALTLSGVQPEDEA EYYCVLWYSNRWVFGGGTKLTVL |

TABLE 15-continued

BiTE Molecule Sequences.

| | DESCRIPTION | SEQUENCE |
|---|---|---|
| | CD3 BINDING DOMAIN (I2E) | |
| 96 | Anti-CD3 CDR-L1 (I2E) | GSSTGAVTSGNYPN |
| 97 | Anti-CD3 CDR-L2 (I2E) | GTKFLAP |
| 98 | Anti-CD3 CDR-L3 (I2E) | VLWYSNRWV |
| 99 | Anti-CD3 CDR-H1 (I2E) | KYAIN |
| 100 | Anti-CD3 CDR-H2 (I2E) | RIRSKYNNYATYYADAVKD |
| 101 | Anti-CD3 CDR-H3 (I2E) | AGNFGSSYISYWAY |
| 102 | Anti-CD3 VH (I2E) | EVQLVESGGGLVQPGGSLKLSCAASGFTFNKYAINWVR QAPGKGLEWVARIRSKYNNYATYYADAVKDRFTISRD DSKNTVYLQMNNLKTEDTAVYYCARAGNFGSSYISYW AYWGQGTLVTVSS |
| 103 | Anti-CD3 VL (I2E) | QTVVTQEPSLTVSPGGTVTITCGSSTGAVTSGNYPNWV QKKPGQAPRGLIGGTKFLAPGTPARFSGSLSGGKAALTL SGVQPEDEAEYYCVLWYSNRWVFGSGTKLTVL |
| | CD33 | |
| 104 | Anti-CD33 CDR-L1 (E11) | KSSQSVLDSSTNKNSLA |
| 105 | Anti-CD33 CDR-L2 (E11) | WASTRES |
| 106 | Anti-CD33 CDR-L3 (E11) | QQSAHFPIT |
| 107 | Anti-CD33 CDR-H1 (E11) | NYGMN |
| 108 | Anti-CD33 CDR-H2 (E11) | WINTYTGEPTYADKFQG |
| 109 | Anti-CD33 CDR-H3 (E11) | WSWSDGYYVYFDY |
| 110 | Anti-CD33 VH with cys-clamp (E11) | QVQLVQSGAEVKKPGESVKVSCKASGYTFTNYGMNW VKQAPGQCLEWMGWINTYTGEPTYADKFQGRVTMTT DTSTSTAYMEIRNLGGDDTAVYYCARWSWSDGYYVYF DYWGQGTSVTVSS |
| 111 | Anti-CD33 VH without cys-clamp (E11) | QVQLVQSGAEVKKPGESVKVSCKASGYTFTNYGMNW VKQAPGQGLEWMGWINTYTGEPTYADKFQGRVTMTT DTSTSTAYMEIRNLGGDDTAVYYCARWSWSDGYYVYF DYWGQGTSVTVSS |
| 112 | Anti-CD33 VL with cys-clamp (E11) | DIVMTQSPDSLTVSLGERTTINCKSSQSVLDSSTNKNSL AWYQQKPGQPPKLLLSWASTRESGIPDRFSGSGSGTDFT LTIDSPQPEDSATYYCQQSAHFPITFGCGTRLEIK |
| 113 | Anti-CD33 VL without cys-clamp (E11) | DIVMTQSPDSLTVSLGERTTINCKSSQSVLDSSTNKNSL AWYQQKPGQPPKLLLSWASTRESGIPDRFSGSGSGTDFT LTIDSPQPEDSATYYCQQSAHFPITFGQGTRLEIK |
| 114 | CD33 scFv with cys-clamp E11 | QVQLVQSGAEVKKPGESVKVSCKASGYTFTNYGMNW VKQAPGQCLEWMGWINTYTGEPTYADKFQGRVTMTT DTSTSTAYMEIRNLGGDDTAVYYCARWSWSDGYYVYF DYWGQGTSVTVSSGGGGSGGGGSGGGGSDIVMTQSPD SLTVSLGERTTINCKSSQSVLDSSTNKNSLAWYQQKPG QPPKLLLSWASTRESGIPDRFSGSGSGTDFTLTIDSPQPE DSATYYCQQSAHFPITFGCGTRLEIK |
| 115 | CD33 scFv without cys-clamp E11 | QVQLVQSGAEVKKPGESVKVSCKASGYTFTNYGMNW VKQAPGQGLEWMGWINTYTGEPTYADKFQGRVTMTT DTSTSTAYMEIRNLGGDDTAVYYCARWSWSDGYYVYF DYWGQGTSVTVSSGGGGSGGGGSGGGGSDIVMTQSPD SLTVSLGERTTINCKSSQSVLDSSTNKNSLAWYQQKPG QPPKLLLSWASTRESGIPDRFSGSGSGTDFTLTIDSPQPE DSATYYCQQSAHFPITFGQGTRLEIK |
| 116 | Anti-CD33 with cys-clamp (E11) x anti-CD3 (I2C) Bispecific molecule | QVQLVQSGAEVKKPGESVKVSCKASGYTFTNYGMNW VKQAPGQCLEWMGWINTYTGEPTYADKFQGRVTMTT DTSTSTAYMEIRNLGGDDTAVYYCARWSWSDGYYVYF DYWGQGTSVTVSSGGGGSGGGGSGGGGSDIVMTQSPD SLTVSLGERTTINCKSSQSVLDSSTNKNSLAWYQQKPG QPPKLLLSWASTRESGIPDRFSGSGSGTDFTLTIDSPQPE DSATYYCQQSAHFPITFGCGTRLEIKSGGGGSEVQLVES GGGLVQPGGSLKLSCAASGFTFNKYAMNWVRQAPGK GLEWVARIRSKYNNYATYYADSVKDRFTISRDDSKNTA YLQMNNLKTEDTAVYYCVRHGNFGNSYISYWAYWGQ GTLVTVSSGGGGSGGGGSGGGGSQTVVTQEPSLTVSPG |

TABLE 15-continued

BiTE Molecule Sequences.

| | DESCRIPTION | SEQUENCE |
|---|---|---|
| 117 | Anti-CD33 with cys-clamp (E11) x anti-CD3 (I2C) scFc Bispecific HLE molecule | GTVTLTCGSSTGAVTSGNYPNWVQQKPGQAPRGLIGGT KFLAPGTPARFSGSLLGGKAALTLSGVQPEDEAEYYCV LWYSNRWVFGGGTKLTVL QVQLVQSGAEVKKPGESVKVSCKASGYTFTNYGMNW VKQAPGQCLEWMGWINTYTGEPTYADKFQGRVTMTT DTSTSTAYMEIRNLGGDDTAVYYCARWSWSDGYYVYF DYWGQGTSVTVSSGGGGSGGGGSGGGGSDIVMTQSPD SLTVSLGERTTINCKSSQSVLDSSTNKNSLAWYQQKPG QPPKLLLSWASTRESGIPDRFSGSGSGTDFTLTIDSPQPE DSATYYCQQSAHFPITFGCGTRLEIKSGGGGSEVQLVES GGGLVQPGGSLKLSCAASGFTFNKYAMNWVRQAPGK GLEWVARIRSKYNNYATYYADSVKDRFTISRDDSKNTA YLQMNNLKTEDTAVYYCVRHGNFGNSYISYWAYWGQ GTLVTVSSGGGGSGGGGSGGGGSQTVVTQEPSLTVSPG GTVTLTCGSSTGAVTSGNYPNWVQQKPGQAPRGLIGGT KFLAPGTPARFSGSLLGGKAALTLSGVQPEDEAEYYCV LWYSNRWVFGGGTKLTVLGGGGDKTHTCPPCPAPELL GGPSVFLFPPKPKDTLMISRTPEVTCVVVDVSHEDPEVK FNWYVDGVEVHNAKTKPCEEQYGSTYRCVSVLTVLHQ DWLNGKEYKCKVSNKALPAPIEKTISKAKGQPREPQVY TLPPSREEMTKNQVSLTCLVKGFYPSDIAVEWESNGQPE NNYKTTPPVLDSDGSFFLYSKLTVDKSRWQQGNVFSCS VMHEALHNHYTQKSLSLSPGKGGGGSGGGGSGGGGSG GGGSGGGGSGGGGSDKTHTCPPCPAPELLGGPSVFLFPP KPKDTLMISRTPEVTCVVVDVSHEDPEVKFNWYVDGV EVHNAKTKPCEEQYGSTYRCVSVLTVLHQDWLNGKEY KCKVSNKALPAPIEKTISKAKGQPREPQVYTLPPSREEM TKNQVSLTCLVKGFYPSDIAVEWESNGQPENNYKTTPP VLDSDGSFFLYSKLTVDKSRWQQGNVFSCSVMHEALH NHYTQKSLSLSPGK |
| 118 | Anti-CD33 bispecific molecule with His-tag (no cys clamp) | QVQLVQSGAE VKKPGESVKV SCKASGYTFT NYGMNWVKQA PGQGLEWMGW INTYTGEPTY ADKFQGRVTM TTDTSTSTAY MEIRNLGGDD TAVYYCARWS WSDGYYVYFD YWGQGTSVTV SSGGGGSGGG GSGGGGSDIV MTQSPDSLTV SLGERTTINC KSSQSVLDSS TNKNSLAWYQ QKPGQPPKLL LSWASTRESG IPDRFSGSGS GTDFTLTIDS PQPEDSATYY CQQSAHFPIT FGQGTRLEIK SGGGGSEVQL VESGGGLVQP GGSLKLSCAA SGFTFNKYAM NWVRQAPGKG LEWVARIRSK YNNYATYYAD SVKDRFTISR DDSKNTAYLQ MNNLKTEDTA VYYCVRHGNF GNSYISYWAY WGQGTLVTVS SGGGGSGGGG SGGGGSQTVV TQEPSLTVSP GGTVTLTCGS STGAVTSGNY PNWVQQKPGQ APRGLIGGTK FLAPGTPARF SGSLLGGKAA LTLSGVQPED EAEYYCVLWY SNRWVFGGGT KLTVLHHHHH H |

EGFRvIII

| | | |
|---|---|---|
| 119 | Anti-EGFRvIII CDR-L1 | RSSQSLVHSDGNTYLS |
| 120 | Anti-EGFRvIII CDR-L2 | RISRRFS |
| 121 | Anti-EGFRvIII CDR-L3 | MQSTHVPRT |
| 122 | Anti-EGFRvIII CDR-H1 | NYGMH |
| 123 | Anti-EGFRvIII CDR-H2 | VIWYDGSDKYYADSVRG |
| 124 | Anti-EGFRvIII CDR-H3 | DGYDILTGNPRDFDY |
| 125 | Anti-EGFRvIII VH | QVQLVESGGGVVQSGRSLRLSCAASGFTFRNYGMHWV RQAPGKCLEWVAVIWYDGSDKYYADSVRGRFTISRDN SKNTLYLQMNSLRAEDTAVYYCARDGYDILTGNPRDF DYWGQGTLVTVSS |
| 126 | Anti-EGFRvIII VL | DTVMTQTPLSSHVTLGQPASISCRSSQSLVHSDGNTYLS WLQQRPGQPPRLLIYRISRRFSGVPDRFSGSGAGTDFTL EISRVEAEDVGVYYCMQSTHVPRTFGCGTKVEIK |
| 127 | EGFRvIII scFv | QVQLVESGGGVVQSGRSLRLSCAASGFTFRNYGMHWV RQAPGKCLEWVAVIWYDGSDKYYADSVRGRFTISRDN SKNTLYLQMNSLRAEDTAVYYCARDGYDILTGNPRDF DYWGQGTLVTVSSGGGGSGGGGSGGGGSDTVMTQTPL SSHVTLGQPASISCRSSQSLVHSDGNTYLSWLQQRPGQP PRLLIYRISRRFSGVPDRFSGSGAGTDFTLEISRVEAEDV GVYYCMQSTHVPRTFGCGTKVEIK |

TABLE 15-continued

BiTE Molecule Sequences.

| | DESCRIPTION | SEQUENCE |
|---|---|---|
| 128 | EGFRvIII_CCxCD3 Bispecific molecule | QVQLVESGGGVVQSGRSLRLSCAASGFTFRNYGMHWV RQAPGKCLEWVAVIWYDGSDKYYADSVRGRFTISRDN SKNTLYLQMNSLRAEDTAVYYCARDGYDILTGNPRDF DYWGQGTLVTVSSGGGGSGGGGSGGGGSDTVMTQTPL SSHVTLGQPASISCRSSQSLVHSDGNTYLSWLQQRPGQP PRLLIYRISRRFSGVPDRFSGSGAGTDFTLEISRVEAEDV GVYYCMQSTHVPRTFGCGTKVEIKSGGGGSEVQLVESG GGLVQPGGSLKLSCAASGFTFNKYAMNWVRQAPGKGL EWVARIRSKYNNYATYYADSVKDRFTISRDDSKNTAYL QMNNLKTEDTAVYYCVRHGNFGNSYISYWAYWGQGT LVTVSSGGGGSGGGGSGGGGSQTVVTQEPSLTVSPGGT VTLTCGSSTGAVTSGNYPNWVQQKPGQAPRGLIGGTKF LAPGTPARFSGSLLGGKAALTLSGVQPEDEAEYYCVLW YSNRWVFGGGTKLTVL |
| 129 | EGFRvIII_CCxCD3-scFc Bispecific HLE molecule | QVQLVESGGGVVQSGRSLRLSCAASGFTFRNYGMHWV RQAPGKCLEWVAVIWYDGSDKYYADSVRGRFTISRDN SKNTLYLQMNSLRAEDTAVYYCARDGYDILTGNPRDF DYWGQGTLVTVSSGGGGSGGGGSGGGGSDTVMTQTPL SSHVTLGQPASISCRSSQSLVHSDGNTYLSWLQQRPGQP PRLLIYRISRRFSGVPDRFSGSGAGTDFTLEISRVEAEDV GVYYCMQSTHVPRTFGCGTKVEIKSGGGGSEVQLVESG GGLVQPGGSLKLSCAASGFTFNKYAMNWVRQAPGKGL EWVARIRSKYNNYATYYADSVKDRFTISRDDSKNTAYL QMNNLKTEDTAVYYCVRHGNFGNSYISYWAYWGQGT LVTVSSGGGGSGGGGSGGGGSQTVVTQEPSLTVSPGGT VTLTCGSSTGAVTSGNYPNWVQQKPGQAPRGLIGGTKF LAPGTPARFSGSLLGGKAALTLSGVQPEDEAEYYCVLW YSNRWVFGGGTKLTVLGGGGDKTHTCPPCPAPELLGGP SVFLFPPKPKDTLMISRTPEVTCVVVDVSHEDPEVKFNW YVDGVEVHNAKTKPCEEQYGSTYRCVSVLTVLHQDWL NGKEYKCKVSNKALPAPIEKTISKAKGQPREPQVYTLPP SREEMTKNQVSLTCLVKGFYPSDIAVEWESNGQPENNY KTTPPVLDSDGSFFLYSKLTVDKSRWQQGNVFSCSVMH EALHNHYTQKSLSLSPGKGGGGSGGGGSGGGGSGGGG SGGGGSGGGGSDKTHTCPPCPAPELLGGPSVFLFPPKPK DTLMISRTPEVTCVVVDVSHEDPEVKFNWYVDGVEVH NAKTKPCEEQYGSTYRCVSVLTVLHQDWLNGKEYKCK VSNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHY TQKSLSLSPGK |

ANTI-MSLN

| | | |
|---|---|---|
| 130 | Anti-MSLN CDR-H1 | DYYMT |
| 131 | Anti-MSLN CDR-H2 | YISSSGSTIYYADSVKG |
| 132 | Anti-MSLN CDR-H3 | DRNSHFDY |
| 133 | Anti-MSLN CDR-L1 | RASQGINTWLA |
| 134 | Anti-MSLN CDR-L2 | GASGLQS |
| 135 | Anti-MSLN CDR-L3 | QQAKSFPRT |
| 136 | Anti-MSLN VH | QVQLVESGGGLVKPGGSLRLSCAASGFTFSDYYMTWIR QAPGKGLEWLSYISSSGSTIYYADSVKGRFTISRDNAKN SLFLQMNSLRAEDTAVYYCARDRNSHFDYWGQGTLVT VSS |
| 137 | Anti-MSLN VL | DIQMTQSPSSVSASVGDRVTITCRASQGINTWLAWYQQ KPGKAPKLLIYGASGLQSGVPSRFSGSGSGTDFTLTISSL QPEDFATYYCQQAKSFPRTFGQGTKVEIK |
| 138 | Anti-MSLN scFv | QVQLVESGGGLVKPGGSLRLSCAASGFTFSDYYMTWIR QAPGKGLEWLSYISSSGSTIYYADSVKGRFTISRDNAKN SLFLQMNSLRAEDTAVYYCARDRNSHFDYWGQGTLVT VSSGGGGSGGGGSGGGGSDIQMTQSPSSVSASVGDRVT ITCRASQGINTWLAWYQQKPGKAPKLLIYGASGLQSGV PSRFSGSGSGTDFTLTISSLQPEDFATYYCQQAKSFPRTF GQGTKVEIK |
| 139 | Anti-MSLN_5 x CD3 (I2C) bispecific molecule | QVQLVESGGGLVKPGGSLRLSCAASGFTFSDYYMTWIR QAPGKGLEWLSYISSSGSTIYYADSVKGRFTISRDNAKN SLFLQMNSLRAEDTAVYYCARDRNSHFDYWGQGTLVT VSSGGGGSGGGGSGGGGSDIQMTQSPSSVSASVGDRVT ITCRASQGINTWLAWYQQKPGKAPKLLIYGASGLQSGV PSRFSGSGSGTDFTLTISSLQPEDFATYYCQQAKSFPRTF GQGTKVEIKSGGGGSEVQLVESGGGLVQPGGSLKLSCA ASGFTFNKYAMNWVRQAPGKGLEWVARIRSKYNNYA TYYADSVKDRFTISRDDSKNTAYLQMNNLKTEDTAVY YCVRHGNFGNSYISYWAYWGQGTLVTVSSGGGGSGGG GSGGGGSQTVVTQEPSLTVSPGGTVTLTCGSSTGAVTS GNYPNWVQQKPGQAPRGLIGGTKFLAPGTPARFSGSLL |

TABLE 15-continued

BiTE Molecule Sequences.

| | DESCRIPTION | SEQUENCE |
|---|---|---|
| | | GGKAALTLSGVQPEDEAEYYCVLWYSNRWVFGGGTK LTVL |
| 140 | MSLN_5xCD3-scFc Bispecific HLE molecule | QVQLVESGGGLVKPGGSLRLSCAASGFTFSDYYMTWIR QAPGKGLEWLSYISSSGSTIYYADSVKGRFTISRDNAKN SLFLQMNSLRAEDTAVYYCARDRNSHFDYWGQGTLVT VSSGGGGSGGGGSGGGGSDIQMTQSPSSVSASVGDRVT ITCRASQGINTWLAWYQQKPGKAPKLLIYGASGLQSGV PSRFSGSGSGTDFTLTISSLQPEDFATYYCQQAKSFPRTF GQGTKVEIKSGGGGSEVQLVESGGGLVQPGGSLKLSCA ASGFTFNKYAMNWVRQAPGKGLEWVARIRSKYNNYA TYYADSVKDRFTISRDDSKNTAYLQMNNLKTEDTAVY YCVRHGNFGNSYISYWAYWGQGTLVTVSSGGGGSGGG GSGGGGSQTVVTQEPSLTVSPGGTVTLTCGSSTGAVTS GNYPNWVQQKPGQAPRGLIGGTKFLAPGTPARFSGSLL GGKAALTLSGVQPEDEAEYYCVLWYSNRWVFGGGTK LTVLGGGGDKTHTCPPCPAPELLGGPSVFLFPPKPKDTL MISRTPEVTCVVVDVSHEDPEVKFNWYVDGVEVHNAK TKPCEEQYGSTYRCVSVLTVLHQDWLNGKEYKCKVSN KALPAPIEKTISKAKGQPREPQVYTLPPSREEMTKNQVS LTCLVKGFYPSDIAVEWESNGQPENNYKTTPPVLDSDG SFFLYSKLTVDKSRWQQGNVFSCSVMHEALHNHYTQK SLSLSPGKGGGGSGGGGSGGGGSGGGGSGGGGSGGGG SDKTHTCPPCPAPELLGGPSVFLFPPKPKDTLMISRTPEV TCVVVDVSHEDPEVKFNWYVDGVEVHNAKTKPCEEQ YGSTYRCVSVLTVLHQDWLNGKEYKCKVSNKALPAPI EKTISKAKGQPREPQVYTLPPSREEMTKNQVSLTCLVK GFYPSDIAVEWESNGQPENNYKTTPPVLDSDGSFFLYSK LTVDKSRWQQGNVFSCSVMHEALHNHYTQKSLSLSPG K |
| 141 | MSLN_5_CCxCD3-scFc Bispecific HLE molecule (with cys-clamp) | QVQLVESGGGLVKPGGSLRLSCAASGFTFSDYYMTWIR QAPGKCLEWLSYISSSGSTIYYADSVKGRFTISRDNAKN SLFLQMNSLRAEDTAVYYCARDRNSHFDYWGQGTLVT VSSGGGGSGGGGSGGGGSDIQMTQSPSSVSASVGDRVT ITCRASQGINTWLAWYQQKPGKAPKLLIYGASGLQSGV PSRFSGSGSGTDFTLTISSLQPEDFATYYCQQAKSFPRTF GCGTKVEIKSGGGGSEVQLVESGGGLVQPGGSLKLSCA ASGFTFNKYAMNWVRQAPGKGLEWVARIRSKYNNYA TYYADSVKDRFTISRDDSKNTAYLQMNNLKTEDTAVY YCVRHGNFGNSYISYWAYWGQGTLVTVSSGGGGSGGG GSGGGGSQTVVTQEPSLTVSPGGTVTLTCGSSTGAVTS GNYPNWVQQKPGQAPRGLIGGTKFLAPGTPARFSGSLL GGKAALTLSGVQPEDEAEYYCVLWYSNRWVFGGGTK LTVLGGGGDKTHTCPPCPAPELLGGPSVFLFPPKPKDTL MISRTPEVTCVVVDVSHEDPEVKFNWYVDGVEVHNAK TKPCEEQYGSTYRCVSVLTVLHQDWLNGKEYKCKVSN KALPAPIEKTISKAKGQPREPQVYTLPPSREEMTKNQVS LTCLVKGFYPSDIAVEWESNGQPENNYKTTPPVLDSDG SFFLYSKLTVDKSRWQQGNVFSCSVMHEALHNHYTQK SLSLSPGKGGGGSGGGGSGGGGSGGGGSGGGGSGGGG SDKTHTCPPCPAPELLGGPSVFLFPPKPKDTLMISRTPEV TCVVVDVSHEDPEVKFNWYVDGVEVHNAKTKPCEEQ YGSTYRCVSVLTVLHQDWLNGKEYKCKVSNKALPAPI EKTISKAKGQPREPQVYTLPPSREEMTKNQVSLTCLVK GFYPSDIAVEWESNGQPENNYKTTPPVLDSDGSFFLYSK LTVDKSRWQQGNVFSCSVMHEALHNHYTQKSLSLSPG K |

CDH19

| | | |
|---|---|---|
| 142 | Anti-CDH19 CDR-H1 | SYGMH |
| 143 | Anti-CDH19 CDR-H2 | FIWYEGSNKYYAESVKD |
| 144 | Anti-CDH19 CDR-H3 | RAGIIGTIGYYYGMDV |
| 145 | Anti-CDH19 CDR-L1 | SGDRLGEKYTS |
| 146 | Anti-CDH19 CDR-L2 | QDTKRPS |
| 147 | Anti-CDH19 CDR-L3 | QAWESSTVV |
| 148 | Anti-CDH19 VH | QVQLVESGGGVVQPGGSLRLSCAASGFTFSSYGMHWV RQAPGKGLEWVAFIWYEGSNKYYAESVKDRFTISRDNS KNTLYLQMNSLRAEDTAVYYCARRAGIIGTIGYYYGM DVWGQGTTVTVSS |
| 149 | CDH19 65254.007 VH with Cys clamp | QVQLVESGGGVVQPGGSLRLSCAASGFTFSSYGMHWV RQAPGKCLEWVAFIWYEGSNKYYAESVKDRFTISRDNS KNTLYLQMNSLRAEDTAVYYCARRAGIIGTIGYYYGM DVWGQGTTVTVSS |
| 150 | Anti-CDH19 VL | SYELTQPPSVSVSPGQTASITCSGDRLGEKYTSWYQQRP GQSPLLVIYQDTKRPSGIPERFSGSNSGNTATLTISGTQA MDEADYYCQAWESSTVVFGGGTKLTVLS |

TABLE 15-continued

BiTE Molecule Sequences.

| | DESCRIPTION | SEQUENCE |
|---|---|---|
| 151 | CDH19 65254.007 VL with Cys clamp | SYELTQPPSVSVSPGQTASITCSGDRLGEKYTSWYQQRP GQSPLLVIYQDTKRPSGIPERFSGSNSGNTATLTISGTQA MDEADYYCQAWESSTVVFGCGTKLTVL |
| 152 | Anti-CDH19 VH-VL | QVQLVESGGGVVQPGGSLRLSCAASGFTFSSYGMHWV RQAPGKGLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGGGTKLTVLS |
| 153 | CDH19 65254.007 scFv with cys clamp | QVQLVESGGGVVQPGGSLRLSCAASGFTFSSYGMHWV RQAPGKCLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGCGTKLTVL |
| 154 | Anti-CDH19 Bispecific molecule | QVQLVESGGGVVQPGGSLRLSCAASGFTFSSYGMHWV RQAPGKGLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGGGTKLTVLSGGGGSEVQLVESGGGLV QPGGSLKLSCAASGFTFNKYAMNWVRQAPGKGLEWV ARIRSKYNNYATYYADSVKDRFTISRDDSKNTAYLQMN NLKTEDTAVYYCVRHGNFGNSYISYWAYWGQGTLVT VSSGGGGSGGGGSGGGGSQTVVTQEPSLTVSPGGTVTL TCGSSTGAVTSGNYPNWVQQKPGQAPRGLIGGTKFLAP GTPARFSGSLLGGKAALTLSGVQPEDEAEYYCVLWYSN RWVFGGGTKLTVLHHHHHH |
| 155 | CDH19 65254.007 Bispecific molecule with cys clamp | QVQLVESGGGVVQPGGSLRLSCAASGFTFSSYGMHWV RQAPGKCLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGCGTKLTVLSGGGGSEVQLVESGGGLV QPGGSLKLSCAASGFTFNKYAMNWVRQAPGKGLEWV ARIRSKYNNYATYYADSVKDRFTISRDDSKNTAYLQMN NLKTEDTAVYYCVRHGNFGNSYISYWAYWGQGTLVT VSSGGGGSGGGGSGGGGSQTVVTQEPSLTVSPGGTVTL TCGSSTGAVTSGNYPNWVQQKPGQAPRGLIGGTKFLAP GTPARFSGSLLGGKAALTLSGVQPEDEAEYYCVLWYSN RWVFGGGTKLTVL |
| 156 | CDH19 65254.007 x I2C -scFc Bispecific HLE molecule | QVQLVESGGGVVQPGGSLRLSCAASGFTFSSYGMHWV RQAPGKGLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGGGTKLTVLSGGGGSEVQLVESGGGLV QPGGSLKLSCAASGFTFNKYAMNWVRQAPGKGLEWV ARIRSKYNNYATYYADSVKDRFTISRDDSKNTAYLQMN NLKTEDTAVYYCVRHGNFGNSYISYWAYWGQGTLVT VSSGGGGSGGGGSGGGGSQTVVTQEPSLTVSPGGTVTL TCGSSTGAVTSGNYPNWVQQKPGQAPRGLIGGTKFLAP GTPARFSGSLLGGKAALTLSGVQPEDEAEYYCVLWYSN RWVFGGGTKLTVLGGGGDKTHTCPPCPAPELLGGPSVF LFPPKPKDTLMISRTPEVTCVVVDVSHEDPEVKFNWYV DGVEVHNAKTKPCEEQYGSTYRCVSVLTVLHQDWLNG KEYKCKVSNKALPAPIEKTISKAKGQPREPQVYTLPPSR EEMTKNQVSLTCLVKGFYPSDIAVEWESNGQPENNYKT TPPVLDSDGSFFLYSKLTVDKSRWQQGNVFSCSVMHEA LHNHYTQKSLSLSPGKGGGGSGGGGSGGGGSGGGGSG GGGSGGGGSDKTHTCPPCPAPELLGGPSVFLFPPKPKDT LMISRTPEVTCVVVDVSHEDPEVKFNWYVDGVEVHNA KTKPCEEQYGSTYRCVSVLTVLHQDWLNGKEYKCKVS NKALPAPIEKTISKAKGQPREPQVYTLPPSREEMTKNQV SLTCLVKGFYPSDIAVEWESNGQPENNYKTTPPVLDSD GSFFLYSKLTVDKSRWQQGNVFSCSVMHEALHNHYTQ KSLSLSPGK |
| 157 | CDH19 65254.007 x I2C -scFc_ Bispecific HLE molecule | QVQLVESGGGVVQPGGSLRLSCAASGFTFSSYGMHWV RQAPGKGLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS |

TABLE 15-continued

BiTE Molecule Sequences.

| DESCRIPTION | SEQUENCE |
|---|---|
| | VSVSPGQTASITCSGDRLGEKYTSWYQQRPGQSPLLVIY QDTKRPSGIPERFSGSNSGNTATLTISGTQAMDEADYYC QAWESSTVVFGGGTKLTVLSGGGGSEVQLVESGGGLV QPGGSLKLSCAASGFTFNKYAMNWVRQAPGKGLEWV ARIRSKYNNYATYYADSVKDRFTISRDDSKNTAYLQMN NLKTEDTAVYYCVRHGNFGNSYISYWAYWGQGTLVT VSSGGGGSGGGGSGGGGSQTVVTQEPSLTVSPGGTVTL TCGSSTGAVTSGNYPNWVQQKPGQAPRGLIGGTKFLAP GTPARFSGSLLGGKAALTLSGVQPEDEAEYYCVLWYSN RWVFGGGTKLTVLGGGGDKTHTCPPCPAPELLGGPSVF LFPPKPKDTLMISRTPEVTCVVVDVSHEDPEVKFNWYV DGVEVHNAKTKPCEEQYGSTYRCVSVLTVLHQDWLNG KEYKCKVSNKALPAPIEKTISKAKGQPREPQVYTLPPSR EEMTKNQVSLTCLVKGFYPSDIAVEWESNGQPENNYKT TPPVLDSDGSFFLYSKLTVDKSRWQQGNVFSCSVMHEA LHNHYTQKSLSLSPGGGGSGGGGSGGGGSGGGGSGGG GSGGGGSDKTHTCPPCPAPELLGGPSVFLFPPKPKDTLM ISRTPEVTCVVVDVSHEDPEVKFNWYVDGVEVHNAKT KPCEEQYGSTYRCVSVLTVLHQDWLNGKEYKCKVSNK ALPAPIEKTISKAKGQPREPQVYTLPPSREEMTKNQVSL TCLVKGFYPSDIAVEWESNGQPENNYKTTPPVLDSDGS FFLYSKLTVDKSRWQQGNVFSCSVMHEALHNHYTQKS LSLSPGK |
| 158 CDH19 65254.007 x I2C -scFc Bispecific HLE molecule with cys clamp | QVQLVESGGGVVQPGGSLRLSCAASGFTFSSYGMHWV RQAPGKCLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGCGTKLTVLSGGGGSEVQLVESGGGLV QPGGSLKLSCAASGFTFNKYAMNWVRQAPGKGLEWV ARIRSKYNNYATYYADSVKDRFTISRDDSKNTAYLQMN NLKTEDTAVYYCVRHGNFGNSYISYWAYWGQGTLVT VSSGGGGSGGGGSGGGGSQTVVTQEPSLTVSPGGTVTL TCGSSTGAVTSGNYPNWVQQKPGQAPRGLIGGTKFLAP GTPARFSGSLLGGKAALTLSGVQPEDEAEYYCVLWYSN RWVFGGGTKLTVLGGGGDKTHTCPPCPAPELLGGPSVF LFPPKPKDTLMISRTPEVTCVVVDVSHEDPEVKFNWYV DGVEVHNAKTKPCEEQYGSTYRCVSVLTVLHQDWLNG KEYKCKVSNKALPAPIEKTISKAKGQPREPQVYTLPPSR EEMTKNQVSLTCLVKGFYPSDIAVEWESNGQPENNYKT TPPVLDSDGSFFLYSKLTVDKSRWQQGNVFSCSVMHEA LHNHYTQKSLSLSPGKGGGGSGGGGSGGGGSGGGGSG GGGSGGGGSDKTHTCPPCPAPELLGGPSVFLFPPKPKDT LMISRTPEVTCVVVDVSHEDPEVKFNWYVDGVEVHNA KTKPCEEQYGSTYRCVSVLTVLHQDWLNGKEYKCKVS NKALPAPIEKTISKAKGQPREPQVYTLPPSREEMTKNQV SLTCLVKGFYPSDIAVEWESNGQPENNYKTTPPVLDSD GSFFLYSKLTVDKSRWQQGNVFSCSVMHEALHNHYTQ KSLSLSPGK |
| 159 CDH19 65254.007 x I2C -scFc_delGK Bispecific HLE molecule with cys clamp | QVQLVESGGGVVQPGGSLRLSCAASGFTFSSYGMHWV RQAPGKCLEWVAFIWYEGSNKYYAESVKDRFTISRDNS KNTLYLQMNSLRAEDTAVYYCARRAGIIGTIGYYYGM DVWGQGTTVTVSSGGGGSGGGGSGGGGSSYELTQPPS VSVSPGQTASITCSGDRLGEKYTSWYQQRPGQSPLLVIY QDTKRPSGIPERFSGSNSGNTATLTISGTQAMDEADYYC QAWESSTVVFGCGTKLTVLSGGGGSEVQLVESGGGLV QPGGSLKLSCAASGFTFNKYAMNWVRQAPGKGLEWV ARIRSKYNNYATYYADSVKDRFTISRDDSKNTAYLQMN NLKTEDTAVYYCVRHGNFGNSYISYWAYWGQGTLVT VSSGGGGSGGGGSGGGGSQTVVTQEPSLTVSPGGTVTL TCGSSTGAVTSGNYPNWVQQKPGQAPRGLIGGTKFLAP GTPARFSGSLLGGKAALTLSGVQPEDEAEYYCVLWYSN RWVFGGGTKLTVLGGGGDKTHTCPPCPAPELLGGPSVF LFPPKPKDTLMISRTPEVTCVVVDVSHEDPEVKFNWYV DGVEVHNAKTKPCEEQYGSTYRCVSVLTVLHQDWLNG KEYKCKVSNKALPAPIEKTISKAKGQPREPQVYTLPPSR EEMTKNQVSLTCLVKGFYPSDIAVEWESNGQPENNYKT TPPVLDSDGSFFLYSKLTVDKSRWQQGNVFSCSVMHEA LHNHYTQKSLSLSPGGGGSGGGGSGGGGSGGGGSGGG GSGGGGSDKTHTCPPCPAPELLGGPSVFLFPPKPKDTLM ISRTPEVTCVVVDVSHEDPEVKFNWYVDGVEVHNAKT KPCEEQYGSTYRCVSVLTVLHQDWLNGKEYKCKVSNK ALPAPIEKTISKAKGQPREPQVYTLPPSREEMTKNQVSL |

TABLE 15-continued

BiTE Molecule Sequences.

| DESCRIPTION | SEQUENCE |
| --- | --- |
| | TCLVKGFYPSDIAVEWESNGQPENNYKTTPPVLDSDGS |
| | FFLYSKLTVDKSRWQQGNVFSCSVMHEALHNHYTQKS |
| | LSLSPGK |

FLT3

| | | |
| --- | --- | --- |
| 160 | Anti-FLT3 CDR-H1 | NARMGVS |
| 161 | Anti-FLT3 CDR-H2 | HIFSNDEKSYSTSLKN |
| 162 | Anti-FLT3 CDR-H3 | IVGYGSGWYGFFDY |
| 163 | Anti-FLT3 CDR-L1 | RASQGIRNDLG |
| 164 | Anti-FLT3 CDR-L2 | AASTLQS |
| 165 | Anti-FLT3 CDR-L3 | LQHNSYPLT |
| 166 | Anti-FLT3 VH | QVTLKESGPTLVKPTETLTLTCTLSGFSLNNARMGVSWI RQPPGKCLEWLAHIFSNDEKSYSTSLKNRLTISKDSSKT QVVLTMTNVDPVDTATYYCARIVGYGSGWYGFFDYW GQGTLVTVSS |
| 167 | Anti-FLT3 VL | DIQMTQSPSSLSASVGDRVTITCRASQGIRNDLGWYQQ KPGKAPKRLIYAASTLQSGVPSRFSGSGSGTEFTLTISSL QPEDFATYYCLQHNSYPLTFGCGTKVEIK |
| 168 | Anti-FLT3 VH-VL | QVTLKESGPTLVKPTETLTLTCTLSGFSLNNARMGVSWI RQPPGKCLEWLAHIFSNDEKSYSTSLKNRLTISKDSSKT QVVLTMTNVDPVDTATYYCARIVGYGSGWYGFFDYW GQGTLVTVSSGGGGSGGGGSGGGGSDIQMTQSPSSLSA SVGDRVTITCRASQGIRNDLGWYQQKPGKAPKRLIYAA STLQSGVPSRFSGSGSGTEFTLTISSLQPEDFATYYCLQH NSYPLTFGCGTKVEIK |
| 169 | FLT3_7 A8xCD3 Bispecific molecule | QVTLKESGPTLVKPTETLTLTCTLSGFSLNNARMGVSWI RQPPGKCLEWLAHIFSNDEKSYSTSLKNRLTISKDSSKT QVVLTMTNVDPVDTATYYCARIVGYGSGWYGFFDYW GQGTLVTVSSGGGGSGGGGSGGGGSDIQMTQSPSSLSA SVGDRVTITCRASQGIRNDLGWYQQKPGKAPKRLIYAA STLQSGVPSRFSGSGSGTEFTLTISSLQPEDFATYYCLQH NSYPLTFGCGTKVEIKSGGGGSEVQLVESGGGLVQPGG SLKLSCAASGFTFNKYAMNWVRQAPGKGLEWVARIRS KYNNYATYYADSVKDRFTISRDDSKNTAYLQMNNLKT EDTAVYYCVRHGNFGNSYISYWAYWGQGTLVTVSSGG GGSGGGGSGGGGSQTVVTQEPSLTVSPGGTVTLTCGSS TGAVTSGNYPNWVQQKPGQAPRGLIGGTKFLAPGTPAR FSGSLLGGKAALTLSGVQPEDEAEYYCVLWYSNRWVF GGGTKLTVL |
| 170 | FLT3_7 A8xCD3-scFc Bispecific HLE molecule | QVTLKESGPTLVKPTETLTLTCTLSGFSLNNARMGVSWI RQPPGKCLEWLAHIFSNDEKSYSTSLKNRLTISKDSSKT QVVLTMTNVDPVDTATYYCARIVGYGSGWYGFFDYW GQGTLVTVSSGGGGSGGGGSGGGGSDIQMTQSPSSLSA SVGDRVTITCRASQGIRNDLGWYQQKPGKAPKRLIYAA STLQSGVPSRFSGSGSGTEFTLTISSLQPEDFATYYCLQH NSYPLTFGCGTKVEIKSGGGGSEVQLVESGGGLVQPGG SLKLSCAASGFTFNKYAMNWVRQAPGKGLEWVARIRS KYNNYATYYADSVKDRFTISRDDSKNTAYLQMNNLKT EDTAVYYCVRHGNFGNSYISYWAYWGQGTLVTVSSGG GGSGGGGSGGGGSQTVVTQEPSLTVSPGGTVTLTCGSS TGAVTSGNYPNWVQQKPGQAPRGLIGGTKFLAPGTPAR FSGSLLGGKAALTLSGVQPEDEAEYYCVLWYSNRWVF GGGTKLTVLGGGGDKTHTCPPCPAPELLGGPSVFLFPPK PKDTLMISRTPEVTCVVVDVSHEDPEVKFNWYVDGVE VHNAKTKPCEEQYGSTYRCVSVLTVLHQDWLNGKEYK CKVSNKALPAPIEKTISKAKGQPREPQVYTLPPSREEMT KNQVSLTCLVKGFYPSDIAVEWESNGQPENNYKTTPPV LDSDGSFFLYSKLTVDKSRWQQGNVFSCSVMHEALHN HYTQKSLSLSPGKGGGGSGGGGSGGGGSGGGGSGGGG SGGGGSDKTHTCPPCPAPELLGGPSVFLFPPKPKDTLMIS RTPEVTCVVVDVSHEDPEVKFNWYVDGVEVHNAKTKP CEEQYGSTYRCVSVLTVLHQDWLNGKEYKCKVSNKAL PAPIEKTISKAKGQPREPQVYTLPPSREEMTKNQVSLTC LVKGFYPSDIAVEWESNGQPENNYKTTPPVLDSDGSFFL YSKLTVDKSRWQQGNVFSCSVMHEALHNHYTQKSLSL SPGK |

ANTI-DLL3

| | | |
| --- | --- | --- |
| 171 | Anti-DLL3 HCDR1 | SYYWS |
| 172 | Anti-DLL3 HCDR2 | YVYYSGTTNYNPSLKS |
| 173 | Anti-DLL3 HCDR3 | IAVTGFYFDY |
| 174 | Anti-DLL3 LCDR1 | RASQRVNNNYLA |
| 175 | Anti-DLL3 LCDR2 | GASSRAT |
| 176 | Anti-DLL3 LCDR3 | QQYDRSPLT |

TABLE 15-continued

BiTE Molecule Sequences.

| | DESCRIPTION | SEQUENCE |
|---|---|---|
| 177 | Anti-DLL3 VH with cys-clamp | QVQLQESGPGLVKPSETLSLTCTVSGGSISSYYWSWIRQ PPGKCLEWIGYVYYSGTTNYNPSLKSRVTISVDTSKNQF SLKLSSVTAADTAVYYCASIAVTGFYFDYWGQGTLVTV SS |
| 178 | Anti-DLL3 VL with cys-clamp | EIVLTQSPGTLSLSPGERVTLSCRASQRVNNNYLAWYQ QRPGQAPRLLIYGASSRATGIPDRFSGSGSGTDFTLTISR LEPEDFAVYYCQQYDRSPLTFGCGTKLEIK |
| 179 | Anti-DLL3 VH-VL with cys-clamp | QVQLQESGPGLVKPSETLSLTCTVSGGSISSYYWSWIRQ PPGKCLEWIGYVYYSGTTNYNPSLKSRVTISVDTSKNQF SLKLSSVTAADTAVYYCASIAVTGFYFDYWGQGTLVTV SSGGGGSGGGGSGGGGSEIVLTQSPGTLSLSPGERVTLS CRASQRVNNNYLAWYQQRPGQAPRLLIYGASSRATGIP DRFSGSGSGTDFTLTISRLEPEDFAVYYCQQYDRSPLTF GCGTKLEIK |
| 180 | DLL3_1_CCxCD3 Bispecific molecule | QVQLQESGPGLVKPSETLSLTCTVSGGSISSYYWSWIRQ PPGKCLEWIGYVYYSGTTNYNPSLKSRVTISVDTSKNQF SLKLSSVTAADTAVYYCASIAVTGFYFDYWGQGTLVTV SSGGGGSGGGGSGGGGSEIVLTQSPGTLSLSPGERVTLS CRASQRVNNNYLAWYQQRPGQAPRLLIYGASSRATGIP DRFSGSGSGTDFTLTISRLEPEDFAVYYCQQYDRSPLTF GCGTKLEIKSGGGGSEVQLVESGGGLVQPGGSLKLSCA ASGFTFNKYAMNWVRQAPGKGLEWVARIRSKYNNYA TYYADSVKDRFTISRDDSKNTAYLQMNNLKTEDTAVY YCVRHGNFGNSYISYWAYWGQGTLVTVSSGGGGSGGG GSGGGGSQTVVTQEPSLTVSPGGTVTLTCGSSTGAVTS GNYPNWVQQKPGQAPRGLIGGTKFLAPGTPARFSGSLL GGKAALTLSGVQPEDEAEYYCVLWYSNRWVFGGGTK LTVL |
| 181 | DLL3_1_CCxCD3-scFc_ Bispecific HLE molecule | QVQLQESGPGLVKPSETLSLTCTVSGGSISSYYWSWIRQ PPGKCLEWIGYVYYSGTTNYNPSLKSRVTISVDTSKNQF SLKLSSVTAADTAVYYCASIAVTGFYFDYWGQGTLVTV SSGGGGSGGGGSGGGGSEIVLTQSPGTLSLSPGERVTLS CRASQRVNNNYLAWYQQRPGQAPRLLIYGASSRATGIP DRFSGSGSGTDFTLTISRLEPEDFAVYYCQQYDRSPLTF GCGTKLEIKSGGGGSEVQLVESGGGLVQPGGSLKLSCA ASGFTFNKYAMNWVRQAPGKGLEWVARIRSKYNNYA TYYADSVKDRFTISRDDSKNTAYLQMNNLKTEDTAVY YCVRHGNFGNSYISYWAYWGQGTLVTVSSGGGGSGGG GSGGGGSQTVVTQEPSLTVSPGGTVTLTCGSSTGAVTS GNYPNWVQQKPGQAPRGLIGGTKFLAPGTPARFSGSLL GGKAALTLSGVQPEDEAEYYCVLWYSNRWVFGGGTK LTVLGGGGDKTHTCPPCPAPELLGGPSVFLFPPKPKDTL MISRTPEVTCVVVDVSHEDPEVKFNWYVDGVEVHNAK TKPCEEQYGSTYRCVSVLTVLHQDWLNGKEYKCKVSN KALPAPIEKTISKAKGQPREPQVYTLPPSREEMTKNQVS LTCLVKGFYPSDIAVEWESNGQPENNYKTTPPVLDSDG SFFLYSKLTVDKSRWQQGNVFSCSVMHEALHNHYTQK SLSLSPGGGGSGGGGSGGGGSGGGGSGGGGSGGGGSD KTHTCPPCPAPELLGGPSVFLFPPKPKDTLMISRTPEVTC VVVDVSHEDPEVKFNWYVDGVEVHNAKTKPCEEQYG STYRCVSVLTVLHQDWLNGKEYKCKVSNKALPAPIEKT ISKAKGQPREPQVYTLPPSREEMTKNQVSLTCLVKGFYP SDIAVEWESNGQPENNYKTTPPVLDSDGSFFLYSKLTVD KSRWQQGNVFSCSVMHEALHNHYTQKSLSLSPGK |
| | ANTI-CD19 | |
| 182 | Anti-CD19 CDR-H1 (97-G1RE-C2) | SYGMH |
| 183 | Anti-CD19 CDR-H2 | VISYEGSNKYYAESVKG |
| 184 | Anti-CD19 CDR-H3 | DRGTIFGNYGLEV |
| 185 | Anti-CD19 CDR-L1 | RSSQSLLHKNAFNYLD |
| 186 | Anti-CD19 CDR-L2 | LGSNRAS |
| 187 | Anti-CD19 CDR-L3 | MQALQTPFT |
| 188 | Anti-CD19 VH | QVQLVESGGGVVQPGRSLRLSCAASGFTFSSYGMHWV RQAPGKCLEWVAVISYEGSNKYYAESVKGRFTISRDNS KNTLYLQMNSLRDEDTAVYYCARDRGTIFGNYGLEVW GQGTTVTVSS |
| 189 | Anti-CD19 VL | DIVMTQSPLSLPVISGEPASISCRSSQSLLHKNAFNYLDW YLQKPGQSPQLLIYLGSNRASGVPDRFSGSGSGTDFTLK ISRVEAEDVGVYYCMQALQTPFTFGCGTKVDIK |
| 190 | Anti-CD19 VL-VH | DIVMTQSPLSLPVISGEPASISCRSSQSLLHKNAFNYLDW YLQKPGQSPQLLIYLGSNRASGVPDRFSGSGSGTDFTLK ISRVEAEDVGVYYCMQALQTPFTFGCGTKVDIKGGGGS GGGGSGGGGSQVQLVESGGGVVQPGRSLRLSCAASGF TFSSYGMHWVRQAPGKCLEWVAVISYEGSNKYYAESV |

TABLE 15-continued

BiTE Molecule Sequences.

| DESCRIPTION | SEQUENCE |
|---|---|
| | KGRFTISRDNSKNTLYLQMNSLRDEDTAVYYCARDRGT<br>IFGNYGLEVWGQGTTVTVSSGGGGSEVQLVESGGGLV<br>QPGGSLKLSCAASGFTFNKYAMNWVRQAPGKGLEWV<br>ARIRSKYNNYATYYADSVKDRFTISRDDSKNTAYLQMN<br>NLKTEDTAVYYCVRHGNFGNSYISYWAYWGQGTLVT<br>VSSGGGGSGGGGSGGGGSQTVVTQEPSLTVSPGGTVTL<br>TCGSSTGAVTSGNYPNWVQQKPGQAPRGLIGGTKFLAP<br>GTPARFSGSLLGGKAALTLSGVQPEDEAEYYCVLWYSN<br>RWVFGGGTKLTVL |
| 191 CD19 97-G1RE-C2 CC x I2C-scFc | DIVMTQSPLSLPVISGEPASISCRSSQSLLHKNAFNYLDW<br>YLQKPGQSPQLLIYLGSNRASGVPDRFSGSGSGTDFTLK<br>ISRVEAEDVGVYYCMQALQTPFTFGCGTKVDIKGGGGS<br>GGGGSGGGGSQVQLVESGGGVVQPGRSLRLSCAASGF<br>TFSSYGMHWVRQAPGKCLEWVAVISYEGSNKYYAESV<br>KGRFTISRDNSKNTLYLQMNSLRDEDTAVYYCARDRGT<br>IFGNYGLEVWGQGTTVTVSSGGGGSEVQLVESGGGLV<br>QPGGSLKLSCAASGFTFNKYAMNWVRQAPGKGLEWV<br>ARIRSKYNNYATYYADSVKDRFTISRDDSKNTAYLQMN<br>NLKTEDTAVYYCVRHGNFGNSYISYWAYWGQGTLVT<br>VSSGGGGSGGGGSGGGGSQTVVTQEPSLTVSPGGTVTL<br>TCGSSTGAVTSGNYPNWVQQKPGQAPRGLIGGTKFLAP<br>GTPARFSGSLLGGKAALTLSGVQPEDEAEYYCVLWYSN<br>RWVFGGGTKLTVLGGGGDKTHTCPPCPAPELLGGPSVF<br>LFPPKPKDTLMISRTPEVTCVVVDVSHEDPEVKFNWYV<br>DGVEVHNAKTKPCEEQYGSTYRCVSVLTVLHQDWLNG<br>KEYKCKVSNKALPAPIEKTISKAKGQPREPQVYTLPPSR<br>EEMTKNQVSLTCLVKGFYPSDIAVEWESNGQPENNYKT<br>TPPVLDSDGSFFLYSKLTVDKSRWQQGNVFSCSVMHEA<br>LHNHYTQKSLSLSPGKGGGGSGGGGSGGGGSGGGGSG<br>GGGSGGGGSDKTHTCPPCPAPELLGGPSVFLFPPKPKDT<br>LMISRTPEVTCVVVDVSHEDPEVKFNWYVDGVEVHNA<br>KTKPCEEQYGSTYRCVSVLTVLHQDWLNGKEYKCKVS<br>NKALPAPIEKTISKAKGQPREPQVYTLPPSREEMTKNQV<br>SLTCLVKGFYPSDIAVEWESNGQPENNYKTTPPVLDSD<br>GSFFLYSKLTVDKSRWQQGNVFSCSVMHEALHNHYTQ<br>KSLSLSPGK |
| BCMA | |
| 192 Anti-BCMA CDR-H1 (27-C4-G7) | NHIIH |
| 193 Anti-BCMA CDR-H2 | YINPYPGYHAYNEKFQG |
| 194 Anti-BCMA CDR-H3 | DGYYRDTDVLDY |
| 195 Anti-BCMA CDR-L1 | QASQDISNYLN |
| 196 Anti-BCMA CDR-L2 | YTSRLHT |
| 197 Anti-BCMA CDR-L3 | QQGNTLPWT |
| 198 Anti-BCMA VH | QVQLVQSGAEVKKPGASVKVSCKASGYTFTNHIIHWVR<br>QAPGQCLEWMGYINPYPGYHAYNEKFQGRATMTSDTS<br>TSTVYMELSSLRSEDTAVYYCARDGYYRDTDVLDYWG<br>QGTLVTVSS |
| 199 Anti-BCMA VL | DIQMTQSPSSLSASVGDRVTITCQASQDISNYLNWYQQ<br>KPGKAPKLLIYYTSRLHTGVPSRFSGSGSGTDFTFTISSL<br>EPEDIATYYCQQGNTLPWTFGCGTKLEIK |
| 200 Anti-BCMA VH-VL | QVQLVQSGAEVKKPGASVKVSCKASGYTFTNHIIHWVR<br>QAPGQCLEWMGYINPYPGYHAYNEKFQGRATMTSDTS<br>TSTVYMELSSLRSEDTAVYYCARDGYYRDTDVLDYWG<br>QGTLVTVSSGGGGSGGGGSGGGGSDIQMTQSPSSLSAS<br>VGDRVTITCQASQDISNYLNWYQQKPGKAPKLLIYYTS<br>RLHTGVPSRFSGSGSGTDFTFTISSLEPEDIATYYCQQGN<br>TLPWTFGCGTKLEIK |
| 201 Anti-BCMA Ic320 bispecific molecule HLE With cys-clamp | QVQLVQSGAEVKKPGASVKVSCKASGYTFTNHIIHWVR<br>QAPGQCLEWMGYINPYPGYHAYNEKFQGRATMTSDTS<br>TSTVYMELSSLRSEDTAVYYCARDGYYRDTDVLDYWG<br>QGTLVTVSSGGGGSGGGGSGGGGSDIQMTQSPSSLSAS<br>VGDRVTITCQASQDISNYLNWYQQKPGKAPKLLIYYTS<br>RLHTGVPSRFSGSGSGTDFTFTISSLEPEDIATYYCQQGN<br>TLPWTFGCGTKLEIKSGGGGSEVQLVESGGGLVQPGGS<br>LKLSCAASGFTFNKYAMNWVRQAPGKGLEWVARIRSK<br>YNNYATYYADSVKDRFTISRDDSKNTAYLQMNNLKTE<br>DTAVYYCVRHGNFGNSYISYWAYWGQGTLVTVSSGG<br>GGSGGGGSGGGGSQTVVTQEPSLTVSPGGTVTLTCGSS<br>TGAVTSGNYPNWVQQKPGQAPRGLIGGTKFLAPGTPAR<br>FSGSLLGGKAALTLSGVQPEDEAEYYCVLWYSNRWVF<br>GGGTKLTVLGGGGDKTHTCPPCPAPELLGGPSVFLFPPK<br>PKDTLMISRTPEVTCVVVDVSHEDPEVKFNWYVDGVE<br>VHNAKTKPCEEQYGSTYRCVSVLTVLHQDWLNGKEYK |

TABLE 15-continued

BiTE Molecule Sequences.

| DESCRIPTION | SEQUENCE |
|---|---|
| | CKVSNKALPAPIEKTISKAKGQPREPQVYTLPPSREEMT<br>KNQVSLTCLVKGFYPSDIAVEWESNGQPENNYKTTPPV<br>LDSDGSFFLYSKLTVDKSRWQQGNVFSCSVMHEALHN<br>HYTQKSLSLSPGKGGGGSGGGGSGGGGSGGGGSGGGG<br>SGGGGSDKTHTCPPCPAPELLGGPSVFLFPPKPKDTLMIS<br>RTPEVTCVVVDVSHEDPEVKFNWYVDGVEVHNAKTKP<br>CEEQYGSTYRCVSVLTVLHQDWLNGKEYKCKVSNKAL<br>PAPIEKTISKAKGQPREPQVYTLPPSREEMTKNQVSLTC<br>LVKGFYPSDIAVEWESNGQPENNYKTTPPVLDSDGSFFL<br>YSKLTVDKSRWQQGNVFSCSVMHEALHNHYTQKSLSL<br>SPGK |
| 202 Anti-BCMA IC20<br>bispecific molecule<br>With cys-clamp | QVQLVQSGAEVKKPGASVKVSCKASGYTFTNHIIHWVR<br>QAPGQCLEWMGYINPYPGYHAYNEKFQGRATMTSDTS<br>TSTVYMELSSLRSEDTAVYYCARDGYYRDTDVLDYWG<br>QGTLVTVSSGGGGSGGGGSGGGGSDIQMTQSPSSLSAS<br>VGDRVTITCQASQDISNYLNWYQQKPGKAPKLLIYYTS<br>RLHTGVPSRFSGSGSGTDFTFTISSLEPEDIATYYCQQGN<br>TLPWTFGCGTKLEIKSGGGGSEVQLVESGGGLVQPGGS<br>LKLSCAASGFTFNKYAMNWVRQAPGKGLEWVARIRSK<br>YNNYATYYADSVKDRFTISRDDSKNTAYLQMNNLKTE<br>DTAVYYCVRHGNFGNSYISYWAYWGQGTLVTVSSGG<br>GGSGGGGSGGGGSQTVVTQEPSLTVSPGGTVTLTCGSS<br>TGAVTSGNYPNWVQQKPGQAPRGLIGGTKFLAPGTPAR<br>FSGSLLGGKAALTLSGVQPEDEAEYYCVLWYSNRWVF<br>GGGTKLTVLHHHHHH |

PSMA

| | | |
|---|---|---|
| 203 | Anti-PSMA CDR-H1<br>PM76-B10.17 | DYYMY |
| 204 | Anti-PSMA CDR-H2 | IISDAGYYTTYYSDIIKG |
| 205 | Anti-PSMA CDR-H3 | GFPLLRHGAMDY |
| 206 | Anti-PSMA CDR-L1 | KASQNVDANVA |
| 207 | Anti-PSMA CDR-L2 | SASYVYW |
| 208 | Anti-PSMA CDR-L3 | QQYDQQLIT |
| 209 | Anti-PSMA VH with<br>cys-clamp<br>PM76-B10.17 | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSS |
| 210 | Anti-PSMA VL with<br>cys-clamp<br>PM76-B10.17 | DIQMTQSPSSLSASVGDRVTITCKASQNVDANVAWYQQ<br>KPGQAPKSLIYSASYVYWDVPSRFSGSASGTDFTLTISS<br>VQSEDFATYYCQQYDQQLITFGCGTKLEIK |
| 211 | Anti-PSMA VH-VL<br>with cys-clamp<br>PM76-B10.17 | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIK |
| 212 | Anti-PSMA x CD3<br>bispecific molecule<br>with cys-clamp<br>PM76-B10.17 | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYWGQGTLVTVSSG<br>GGGSGGGGSGGGGSQTVVTQEPSLTVSPGGTVTLTCGS<br>STGAVTSGNYPNWVQQKPGQAPRGLIGGTKFLAPGTPA<br>RFSGSLLGGKAALTLSGVQPEDEAEYYCVLWYSNRWV<br>FGGGTKLTVL |
| 213 | Anti-PSMA x CD3 -<br>scFc bispecific<br>molecule<br>HLE<br>PM76-B10.17 | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYWGQGTLVTVSSG<br>GGGSGGGGSGGGGSQTVVTQEPSLTVSPGGTVTLTCGS<br>STGAVTSGNYPNWVQQKPGQAPRGLIGGTKFLAPGTPA<br>RFSGSLLGGKAALTLSGVQPEDEAEYYCVLWYSNRWV |

TABLE 15-continued

BiTE Molecule Sequences.

| DESCRIPTION | SEQUENCE |
|---|---|
| | FGGGTKLTVLGGGGDKTHTCPPCPAPELLGGPSVFLFPP<br>KPKDTLMISRTPEVTCVVVDVSHEDPEVKFNWYVDGV<br>EVHNAKTKPCEEQYGSTYRCVSVLTVLHQDWLNGKEY<br>KCKVSNKALPAPIEKTISKAKGQPREPQVYTLPPSREEM<br>TKNQVSLTCLVKGFYPSDIAVEWESNGQPENNYKTTPP<br>VLDSDGSFFLYSKLTVDKSRWQQGNVFSCSVMHEALH<br>NHYTQKSLSLSPGKGGGGSGGGGSGGGGSGGGGSGGG<br>GSGGGGSDKTHTCPPCPAPELLGGPSVFLFPPKPKDTLM<br>ISRTPEVTCVVVDVSHEDPEVKFNWYVDGVEVHNAKT<br>KPCEEQYGSTYRCVSVLTVLHQDWLNGKEYKCKVSNK<br>ALPAPIEKTISKAKGQPREPQVYTLPPSREEMTKNQVSL<br>TCLVKGFYPSDIAVEWESNGQPENNYKTTPPVLDSDGS<br>FFLYSKLTVDKSRWQQGNVFSCSVMHEALHNHYTQKS<br>LSLSPGK |
| 214 Anti-PSMA x CD3 -<br>scFc -bispecific<br>molecule<br>HLE<br>PM76-B10.17 | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYWGQGTLVTVSSG<br>GGGSGGGGSGGGGSQTVVTQEPSLTVSPGGTVTLTCGS<br>STGAVTSGNYPNWVQQKPGQAPRGLIGGTKFLAPGTPA<br>RFSGSLLGGKAALTLSGVQPEDEAEYYCVLWYSNRWV<br>FGGGTKLTVLGGGGDKTHTCPPCPAPELLGGPSVFLFPP<br>KPKDTLMISRTPEVTCVVVDVSHEDPEVKFNWYVDGV<br>EVHNAKTKPCEEQYGSTYRCVSVLTVLHQDWLNGKEY<br>KCKVSNKALPAPIEKTISKAKGQPREPQVYTLPPSREEM<br>TKNQVSLTCLVKGFYPSDIAVEWESNGQPENNYKTTPP<br>VLDSDGSFFLYSKLTVDKSRWQQGNVFSCSVMHEALH<br>NHYTQKSLSLSPGGGSGGGGSGGGGSGGGGSGGGGS<br>GGGGSDKTHTCPPCPAPELLGGPSVFLFPPKPKDTLMIS<br>RTPEVTCVVVDVSHEDPEVKFNWYVDGVEVHNAKTKP<br>CEEQYGSTYRCVSVLTVLHQDWLNGKEYKCKVSNKAL<br>PAPIEKTISKAKGQPREPQVYTLPPSREEMTKNQVSLTC<br>LVKGFYPSDIAVEWESNGQPENNYKTTPPVLDSDGSFFL<br>YSKLTVDKSRWQQGNVFSCSVMHEALHNHYTQKSLSL<br>SPGK |
| 215 PM76-B10.17 (cys<br>clamp) x CD3 (Cys<br>clamp 103/43)<br>bispecific molecule | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYCGQGTLVTVSSG<br>GGGSGGGGSGGGGSQTVVTQEPSLTVSPGGTVTLTCGS<br>STGAVTSGNYPNWVQQKPGQCPRGLIGGTKFLAPGTPA<br>RFSGSLLGGKAALTLSGVQPEDEAEYYCVLWYSNRWV<br>FGGGTKLTVL |
| 216 PM76-B10.17 (cys<br>clamp) x CD3 (cys<br>clamp 103/43)-scFc<br>bispecific<br>HLE molecule | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYCGQGTLVTVSSG<br>GGGSGGGGSGGGGSQTVVTQEPSLTVSPGGTVTLTCGS<br>STGAVTSGNYPNWVQQKPGQCPRGLIGGTKFLAPGTPA<br>RFSGSLLGGKAALTLSGVQPEDEAEYYCVLWYSNRWV<br>FGGGTKLTVLGGGGDKTHTCPPCPAPELLGGPSVFLFPP<br>KPKDTLMISRTPEVTCVVVDVSHEDPEVKFNWYVDGV<br>EVHNAKTKPCEEQYGSTYRCVSVLTVLHQDWLNGKEY<br>KCKVSNKALPAPIEKTISKAKGQPREPQVYTLPPSREEM<br>TKNQVSLTCLVKGFYPSDIAVEWESNGQPENNYKTTPP<br>VLDSDGSFFLYSKLTVDKSRWQQGNVFSCSVMHEALH<br>NHYTQKSLSLSPGKGGGGSGGGGSGGGGSGGGGSGGG<br>GSGGGGSDKTHTCPPCPAPELLGGPSVFLFPPKPKDTLM |

TABLE 15-continued

BiTE Molecule Sequences.

| DESCRIPTION | SEQUENCE |
|---|---|
| | ISRTPEVTCVVVDVSHEDPEVKFNWYVDGVEVHNAKT<br>KPCEEQYGSTYRCVSVLTVLHQDWLNGKEYKCKVSNK<br>ALPAPIEKTISKAKGQPREPQVYTLPPSREEMTKNQVSL<br>TCLVKGFYPSDIAVEWESNGQPENNYKTTPPVLDSDGS<br>FFLYSKLTVDKSRWQQGNVFSCSVMHEALHNHYTQKS<br>LSLSPGK |
| 217 PM76-B10.17 (cys clamp) x CD3 (cys clamp 103/43)-scFc bispecific HLE molecule | QVQLVESGGGLVKPGESLRLSCAASGFTFSDYYMYWV<br>RQAPGKCLEWVAIISDAGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDANVAWYQQKPGQAPKSLIYSA<br>SYVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYCGQGTLVTVSSG<br>GGGSGGGGSGGGGSQTVVTQEPSLTVSPGGTVTLTCGS<br>STGAVTSGNYPNWVQQKPGQCPRGLIGGTKFLAPGTPA<br>RFSGSLLGGKAALTLSGVQPEDEAEYYCVLWYSNRWV<br>FGGGTKLTVLGGGGDKTHTCPPCPAPELLGGPSVFLFPP<br>KPKDTLMISRTPEVTCVVVDVSHEDPEVKFNWYVDGV<br>EVHNAKTKPCEEQYGSTYRCVSVLTVLHQDWLNGKEY<br>KCKVSNKALPAPIEKTISKAKGQPREPQVYTLPPSREEM<br>TKNQVSLTCLVKGFYPSDIAVEWESNGQPENNYKTTPP<br>VLDSDGSFFLYSKLTVDKSRWQQGNVFSCSVMHEALH<br>NHYTQKSLSLSPGGGGSGGGGSGGGGSGGGGSGGGGS<br>GGGGSDKTHTCPPCPAPELLGGPSVFLFPPKPKDTLMIS<br>RTPEVTCVVVDVSHEDPEVKFNWYVDGVEVHNAKTKP<br>CEEQYGSTYRCVSVLTVLHQDWLNGKEYKCKVSNKAL<br>PAPIEKTISKAKGQPREPQVYTLPPSREEMTKNQVSLTC<br>LVKGFYPSDIAVEWESNGQPENNYKTTPPVLDSDGSFFL<br>YSKLTVDKSRWQQGNVFSCSVMHEALHNHYTQKSLSL<br>SPGK |
| PSMA | |
| 218 Anti-PSMA CDR-H1 (PM76-B10.11) | DYYMY |
| 219 Anti-PSMA CDR-H2 | IISDGGYYTYYSDIIKG |
| 220 Anti-PSMA CDR-H3 | GFPLLRHGAMDY |
| 221 Anti-PSMA CDR-L1 | KASQNVDTNVA |
| 222 Anti-PSMA CDR-L2 | SASYVYW |
| 223 Anti-PSMA CDR-L3 | QQYDQQLIT |
| 224 Anti-PSMA VH without cys-clamp PM76-B10.11 | QVQLVESGGGLVKPGESLRLSCAASGFTFSDYYMYWV<br>RQAPGKGLEWVAIISDGGYYTYYSDIIKGRFTISRDNAK<br>NSLYLQMNSLKAEDTAVYYCARGFPLLRHGAMDYWG<br>QGTLVTVSS |
| 225 Anti-PSMA VH with cys-clamp PM76-B10.11 | QVQLVESGGGLVKPGESLRLSCAASGFTFSDYYMYWV<br>RQAPGKCLEWVAIISDGGYYTYYSDIIKGRFTISRDNAK<br>NSLYLQMNSLKAEDTAVYYCARGFPLLRHGAMDYWG<br>QGTLVTVSS |
| 226 Anti-PSMA VL without cys-clamp PM76-B10.11 | DIQMTQSPSSLSASVGDRVTITCKASQNVDTNVAWYQQ<br>KPGQAPKSLIYSASYVYWDVPSRFSGSASGTDFTLTISS<br>VQSEDFATYYCQQYDQQLITFGGGTKLEIK |
| 227 Anti-PSMA VL with cys-clamp PM76-B10.11 | DIQMTQSPSSLSASVGDRVTITCKASQNVDTNVAWYQQ<br>KPGQAPKSLIYSASYVYWDVPSRFSGSASGTDFTLTISS<br>VQSEDFATYYCQQYDQQLITFGCGTKLEIK |
| 228 Anti-PSMA VH-VL without cys-clamp PM76-B10.11 | QVQLVESGGGLVKPGESLRLSCAASGFTFSDYYMYWV<br>RQAPGKGLEWVAIISDGGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDTNVAWYQQKPGQAPKSLIYSAS<br>YVYWDVPSRFSGSASGTDFTLTISSVQSEDFATYYCQQ<br>YDQQLITFGGGTKLEIK |
| 229 Anti-PSMA VH-VL with cys-clamp PM76-B10.11 | QVQLVESGGGLVKPGESLRLSCAASGFTFSDYYMYWV<br>RQAPGKCLEWVAIISDGGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDTNVAWYQQKPGQAPKSLIYSAS<br>YVYWDVPSRFSGSASGTDFTLTISSVQSEDFATYYCQQ<br>YDQQLITFGCGTKLEIK |
| 230 Anti-PSMA x CD3 without cys-clamp Bispecific molecule PM76-B10.11 | QVQLVESGGGLVKPGESLRLSCAASGFTFSDYYMYWV<br>RQAPGKGLEWVAIISDGGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDTNVAWYQQKPGQAPKSLIYSAS |

TABLE 15-continued

BiTE Molecule Sequences.

| DESCRIPTION | SEQUENCE |
|---|---|
| | YVYWDVPSRFSGSASGTDFTLTISSVQSEDFATYYCQQ
YDQQLITFGGGTKLEIKSGGGGSEVQLVESGGGLVQPG
GSLKLSCAASGFTFNKYAMNWVRQAPGKGLEWVARIR
SKYNNYATYYADSVKDRFTISRDDSKNTAYLQMNNLK
TEDTAVYYCVRHGNFGNSYISYWAYWGQGTLVTVSSG
GGGSGGGGSGGGGSQTVVTQEPSLTVSPGGTVTLTCGS
STGAVTSGNYPNWVQQKPGQAPRGLIGGTKFLAPGTPA
RFSGSLLGGKAALTLSGVQPEDEAEYYCVLWYSNRWV
FGGGTKLTVL |
| 231 Anti-PSMA x CD3 with cys-clamp Bispecific molecule PM76-B10.11 | QVQLVESGGGLVKPGESLRLSCAASGFTFSDYYMYWV
RQAPGKCLEWVAIISDGGYYTYYSDIIKGRFTISRDNAK
NSLYLQMNSLKAEDTAVYYCARGFPLLRHGAMDYWG
QGTLVTVSSGGGGSGGGGSGGGGSDIQMTQSPSSLSAS
VGDRVTITCKASQNVDTNVAWYQQKPGQAPKSLIYSAS
YVYWDVPSRFSGSASGTDFTLTISSVQSEDFATYYCQQ
YDQQLITFGCGTKLEIKSGGGGSEVQLVESGGGLVQPG
GSLKLSCAASGFTFNKYAMNWVRQAPGKGLEWVARIR
SKYNNYATYYADSVKDRFTISRDDSKNTAYLQMNNLK
TEDTAVYYCVRHGNFGNSYISYWAYWGQGTLVTVSSG
GGGSGGGGSGGGGSQTVVTQEPSLTVSPGGTVTLTCGS
STGAVTSGNYPNWVQQKPGQAPRGLIGGTKFLAPGTPA
RFSGSLLGGKAALTLSGVQPEDEAEYYCVLWYSNRWV
FGGGTKLTVL |
| 232 Anti-PSMA x CD3 - scFc without cys-clamp Bispecific molecule HLE PM76-B10.11 | QVQLVESGGGLVKPGESLRLSCAASGFTFSDYYMYWV
RQAPGKGLEWVAIISDGGYYTYYSDIIKGRFTISRDNAK
NSLYLQMNSLKAEDTAVYYCARGFPLLRHGAMDYWG
QGTLVTVSSGGGGSGGGGSGGGGSDIQMTQSPSSLSAS
VGDRVTITCKASQNVDTNVAWYQQKPGQAPKSLIYSAS
YVYWDVPSRFSGSASGTDFTLTISSVQSEDFATYYCQQ
YDQQLITFGGGTKLEIKSGGGGSEVQLVESGGGLVQPG
GSLKLSCAASGFTFNKYAMNWVRQAPGKGLEWVARIR
SKYNNYATYYADSVKDRFTISRDDSKNTAYLQMNNLK
TEDTAVYYCVRHGNFGNSYISYWAYWGQGTLVTVSSG
GGGSGGGGSGGGGSQTVVTQEPSLTVSPGGTVTLTCGS
STGAVTSGNYPNWVQQKPGQAPRGLIGGTKFLAPGTPA
RFSGSLLGGKAALTLSGVQPEDEAEYYCVLWYSNRWV
FGGGTKLTVLGGGGDKTHTCPPCPAPELLGGPSVFLFPP
KPKDTLMISRTPEVTCVVVDVSHEDPEVKFNWYVDGV
EVHNAKTKPCEEQYGSTYRCVSVLTVLHQDWLNGKEY
KCKVSNKALPAPIEKTISKAKGQPREPQVYTLPPSREEM
TKNQVSLTCLVKGFYPSDIAVEWESNGQPENNYKTTPP
VLDSDGSFFLYSKLTVDKSRWQQGNVFSCSVMHEALH
NHYTQKSLSLSPGKGGGGSGGGGSGGGGSGGGGSGGG
GSGGGGSDKTHTCPPCPAPELLGGPSVFLFPPKPKDTLM
ISRTPEVTCVVVDVSHEDPEVKFNWYVDGVEVHNAKT
KPCEEQYGSTYRCVSVLTVLHQDWLNGKEYKCKVSNK
ALPAPIEKTISKAKGQPREPQVYTLPPSREEMTKNQVSL
TCLVKGFYPSDIAVEWESNGQPENNYKTTPPVLDSDGS
FFLYSKLTVDKSRWQQGNVFSCSVMHEALHNHYTQKS
LSLSPGK |
| 233 PM76-B10.11 x CD3 - scFc_ bispecific HLE molecule (without cys clamp) | QVQLVESGGGLVKPGESLRLSCAASGFTFSDYYMYWV
RQAPGKGLEWVAIISDGGYYTYYSDIIKGRFTISRDNAK
NSLYLQMNSLKAEDTAVYYCARGFPLLRHGAMDYWG
QGTLVTVSSGGGGSGGGGSGGGGSDIQMTQSPSSLSAS
VGDRVTITCKASQNVDTNVAWYQQKPGQAPKSLIYSAS
YVYWDVPSRFSGSASGTDFTLTISSVQSEDFATYYCQQ
YDQQLITFGGGTKLEIKSGGGGSEVQLVESGGGLVQPG
GSLKLSCAASGFTFNKYAMNWVRQAPGKGLEWVARIR
SKYNNYATYYADSVKDRFTISRDDSKNTAYLQMNNLK
TEDTAVYYCVRHGNFGNSYISYWAYWGQGTLVTVSSG
GGGSGGGGSGGGGSQTVVTQEPSLTVSPGGTVTLTCGS
STGAVTSGNYPNWVQQKPGQAPRGLIGGTKFLAPGTPA
RFSGSLLGGKAALTLSGVQPEDEAEYYCVLWYSNRWV
FGGGTKLTVLGGGGDKTHTCPPCPAPELLGGPSVFLFPP
KPKDTLMISRTPEVTCVVVDVSHEDPEVKFNWYVDGV
EVHNAKTKPCEEQYGSTYRCVSVLTVLHQDWLNGKEY
KCKVSNKALPAPIEKTISKAKGQPREPQVYTLPPSREEM
TKNQVSLTCLVKGFYPSDIAVEWESNGQPENNYKTTPP
VLDSDGSFFLYSKLTVDKSRWQQGNVFSCSVMHEALH
NHYTQKSLSLSPGGGGSGGGGSGGGGSGGGGSGGGGS
GGGGSDKTHTCPPCPAPELLGGPSVFLFPPKPKDTLMIS
RTPEVTCVVVDVSHEDPEVKFNWYVDGVEVHNAKTKP
CEEQYGSTYRCVSVLTVLHQDWLNGKEYKCKVSNKAL |

TABLE 15-continued

BiTE Molecule Sequences.

| DESCRIPTION | SEQUENCE |
|---|---|
| | PAPIEKTISKAKGQPREPQVYTLPPSREEMTKNQVSLTC LVKGFYPSDIAVEWESNGQPENNYKTTPPVLDSDGSFFL YSKLTVDKSRWQQGNVFSCSVMHEALHNHYTQKSLSL SPGK |
| 234 PM76-B10.11 x CD3 (cys clamp 103/43) bispecific molecule | QVQLVESGGGLVKPGESLRLSCAASGFTFSDYYMYWV RQAPGKGLEWVAIISDGGYYTYYSDIIKGRFTISRDNAK NSLYLQMNSLKAEDTAVYYCARGFPLLRHGAMDYWG QGTLVTVSSGGGGSGGGGSGGGGSDIQMTQSPSSLSAS VGDRVTITCKASQNVDTNVAWYQQKPGQAPKSLIYSAS YVYWDVPSRFSGSASGTDFTLTISSVQSEDFATYYCQQ YDQQLITFGGGTKLEIKSGGGGSEVQLVESGGGLVQPG GSLKLSCAASGFTFNKYAMNWVRQAPGKGLEWVARIR SKYNNYATYYADSVKDRFTISRDDSKNTAYLQMNNLK TEDTAVYYCVRHGNFGNSYISYWAYCGQGTLVTVSSG GGGSGGGGSGGGGSQTVVTQEPSLTVSPGGTVTLTCGS STGAVTSGNYPNWVQQKPGQCPRGLIGGTKFLAPGTPA RFSGSLLGGKAALTLSGVQPEDEAEYYCVLWYSNRWV FGGGTKLTVL |
| 235 PM76-B10.11 x CD3 (cys clamp 103/43)-scFc bispecific HLE molecule | QVQLVESGGGLVKPGESLRLSCAASGFTFSDYYMYWV RQAPGKGLEWVAIISDGGYYTYYSDIIKGRFTISRDNAK NSLYLQMNSLKAEDTAVYYCARGFPLLRHGAMDYWG QGTLVTVSSGGGGSGGGGSGGGGSDIQMTQSPSSLSAS VGDRVTITCKASQNVDTNVAWYQQKPGQAPKSLIYSAS YVYWDVPSRFSGSASGTDFTLTISSVQSEDFATYYCQQ YDQQLITFGGGTKLEIKSGGGGSEVQLVESGGGLVQPG GSLKLSCAASGFTFNKYAMNWVRQAPGKGLEWVARIR SKYNNYATYYADSVKDRFTISRDDSKNTAYLQMNNLK TEDTAVYYCVRHGNFGNSYISYWAYCGQGTLVTVSSG GGGSGGGGSGGGGSQTVVTQEPSLTVSPGGTVTLTCGS STGAVTSGNYPNWVQQKPGQCPRGLIGGTKFLAPGTPA RFSGSLLGGKAALTLSGVQPEDEAEYYCVLWYSNRWV FGGGTKLTVLGGGGDKTHTCPPCPAPELLGGPSVFLFPP KPKDTLMISRTPEVTCVVVDVSHEDPEVKFNWYVDGV EVHNAKTKPCEEQYGSTYRCVSVLTVLHQDWLNGKEY KCKVSNKALPAPIEKTISKAKGQPREPQVYTLPPSREEM TKNQVSLTCLVKGFYPSDIAVEWESNGQPENNYKTTPP VLDSDGSFFLYSKLTVDKSRWQQGNVFSCSVMHEALH NHYTQKSLSLSPGKGGGGSGGGGSGGGGSGGGGSGGG GSGGGGSDKTHTCPPCPAPELLGGPSVFLFPPKPKDTLM ISRTPEVTCVVVDVSHEDPEVKFNWYVDGVEVHNAKT KPCEEQYGSTYRCVSVLTVLHQDWLNGKEYKCKVSNK ALPAPIEKTISKAKGQPREPQVYTLPPSREEMTKNQVSL TCLVKGFYPSDIAVEWESNGQPENNYKTTPPVLDSDGS FFLYSKLTVDKSRWQQGNVFSCSVMHEALHNHYTQKS LSLSPGK |
| 236 PM76-B10.11 x CD3 (cys clamp 103/43)-scFc_ bispecific HLE molecule | QVQLVESGGGLVKPGESLRLSCAASGFTFSDYYMYWV RQAPGKGLEWVAIISDGGYYTYYSDIIKGRFTISRDNAK NSLYLQMNSLKAEDTAVYYCARGFPLLRHGAMDYWG QGTLVTVSSGGGGSGGGGSGGGGSDIQMTQSPSSLSAS VGDRVTITCKASQNVDTNVAWYQQKPGQAPKSLIYSAS YVYWDVPSRFSGSASGTDFTLTISSVQSEDFATYYCQQ YDQQLITFGGGTKLEIKSGGGGSEVQLVESGGGLVQPG GSLKLSCAASGFTFNKYAMNWVRQAPGKGLEWVARIR SKYNNYATYYADSVKDRFTISRDDSKNTAYLQMNNLK TEDTAVYYCVRHGNFGNSYISYWAYCGQGTLVTVSSG GGGSGGGGSGGGGSQTVVTQEPSLTVSPGGTVTLTCGS STGAVTSGNYPNWVQQKPGQCPRGLIGGTKFLAPGTPA RFSGSLLGGKAALTLSGVQPEDEAEYYCVLWYSNRWV FGGGTKLTVLGGGGDKTHTCPPCPAPELLGGPSVFLFPP KPKDTLMISRTPEVTCVVVDVSHEDPEVKFNWYVDGV EVHNAKTKPCEEQYGSTYRCVSVLTVLHQDWLNGKEY KCKVSNKALPAPIEKTISKAKGQPREPQVYTLPPSREEM TKNQVSLTCLVKGFYPSDIAVEWESNGQPENNYKTTPP VLDSDGSFFLYSKLTVDKSRWQQGNVFSCSVMHEALH NHYTQKSLSLSPGGGGSGGGGSGGGGSGGGGSGGGGS GGGGSDKTHTCPPCPAPELLGGPSVFLFPPKPKDTLMIS RTPEVTCVVVDVSHEDPEVKFNWYVDGVEVHNAKTKP CEEQYGSTYRCVSVLTVLHQDWLNGKEYKCKVSNKAL PAPIEKTISKAKGQPREPQVYTLPPSREEMTKNQVSLTC LVKGFYPSDIAVEWESNGQPENNYKTTPPVLDSDGSFFL YSKLTVDKSRWQQGNVFSCSVMHEALHNHYTQKSLSL SPGK |

TABLE 15-continued

BiTE Molecule Sequences.

| DESCRIPTION | SEQUENCE |
| --- | --- |
| 237 Anti-PSMA x CD3 with cys-clamp, scFc Bispecific molecule HLE PM76-B10.11 | QVQLVESGGGLVKPGESLRLSCAASGFTFSDYYMYWV RQAPGKCLEWVAIISDGGYYTYYSDIIKGRFTISRDNAK NSLYLQMNSLKAEDTAVYYCARGFPLLRHGAMDYWG QGTLVTVSSGGGGSGGGGSGGGGSDIQMTQSPSSLSAS VGDRVTITCKASQNVDTNVAWYQQKPGQAPKSLIYSAS YVYWDVPSRFSGSASGTDFTLTISSVQSEDFATYYCQQ YDQQLITFGCGTKLEIKSGGGGSEVQLVESGGGLVQPG GSLKLSCAASGFTFNKYAMNWVRQAPGKGLEWVARIR SKYNNYATYYADSVKDRFTISRDDSKNTAYLQMNNLK TEDTAVYYCVRHGNFGNSYISYWAYWGQGTLVTVSSG GGGSGGGGSGGGGSQTVVTQEPSLTVSPGGTVTLTCGS STGAVTSGNYPNWVQQKPGQAPRGLIGGTKFLAPGTPA RFSGSLLGGKAALTLSGVQPEDEAEYYCVLWYSNRWV FGGGTKLTVLGGGGDKTHTCPPCPAPELLGGPSVFLFPP KPKDTLMISRTPEVTCVVVDVSHEDPEVKFNWYVDGV EVHNAKTKPCEEQYGSTYRCVSVLTVLHQDWLNGKEY KCKVSNKALPAPIEKTISKAKGQPREPQVYTLPPSREEM TKNQVSLTCLVKGFYPSDIAVEWESNGQPENNYKTTPP VLDSDGSFFLYSKLTVDKSRWQQGNVFSCSVMHEALH NHYTQKSLSLSPGKGGGGSGGGGSGGGGSGGGGSGGG GSGGGGSDKTHTCPPCPAPELLGGPSVFLFPPKPKDTLM ISRTPEVTCVVVDVSHEDPEVKFNWYVDGVEVHNAKT KPCEEQYGSTYRCVSVLTVLHQDWLNGKEYKCKVSNK ALPAPIEKTISKAKGQPREPQVYTLPPSREEMTKNQVSL TCLVKGFYPSDIAVEWESNGQPENNYKTTPPVLDSDGS FFLYSKLTVDKSRWQQGNVFSCSVMHEALHNHYTQKS LSLSPGK |
| 238 PM76-B10.11 CD3 with cys-clamp, scFc_ bispecific HLE molecule | QVQLVESGGGLVKPGESLRLSCAASGFTFSDYYMYWV RQAPGKCLEWVAIISDGGYYTYYSDIIKGRFTISRDNAK NSLYLQMNSLKAEDTAVYYCARGFPLLRHGAMDYWG QGTLVTVSSGGGGSGGGGSGGGGSDIQMTQSPSSLSAS VGDRVTITCKASQNVDTNVAWYQQKPGQAPKSLIYSAS YVYWDVPSRFSGSASGTDFTLTISSVQSEDFATYYCQQ YDQQLITFGCGTKLEIKSGGGGSEVQLVESGGGLVQPG GSLKLSCAASGFTFNKYAMNWVRQAPGKGLEWVARIR SKYNNYATYYADSVKDRFTISRDDSKNTAYLQMNNLK TEDTAVYYCVRHGNFGNSYISYWAYWGQGTLVTVSSG GGGSGGGGSGGGGSQTVVTQEPSLTVSPGGTVTLTCGS STGAVTSGNYPNWVQQKPGQAPRGLIGGTKFLAPGTPA RFSGSLLGGKAALTLSGVQPEDEAEYYCVLWYSNRWV FGGGTKLTVLGGGGDKTHTCPPCPAPELLGGPSVFLFPP KPKDTLMISRTPEVTCVVVDVSHEDPEVKFNWYVDGV EVHNAKTKPCEEQYGSTYRCVSVLTVLHQDWLNGKEY KCKVSNKALPAPIEKTISKAKGQPREPQVYTLPPSREEM TKNQVSLTCLVKGFYPSDIAVEWESNGQPENNYKTTPP VLDSDGSFFLYSKLTVDKSRWQQGNVFSCSVMHEALH NHYTQKSLSLSPGGGGSGGGGSGGGGSGGGGSGGGGS GGGGSDKTHTCPPCPAPELLGGPSVFLFPPKPKDTLMIS RTPEVTCVVVDVSHEDPEVKFNWYVDGVEVHNAKTKP CEEQYGSTYRCVSVLTVLHQDWLNGKEYKCKVSNKAL PAPIEKTISKAKGQPREPQVYTLPPSREEMTKNQVSLTC LVKGFYPSDIAVEWESNGQPENNYKTTPPVLDSDGSFFL YSKLTVDKSRWQQGNVFSCSVMHEALHNHYTQKSLSL SPGK |
| 239 PM76-B10.11 x CD3 scFc bispecific HLE molecule (with cys-clamp; second cys clamp at CD3 103/43) | QVQLVESGGGLVKPGESLRLSCAASGFTFSDYYMYWV RQAPGKCLEWVAIISDGGYYTYYSDIIKGRFTISRDNAK NSLYLQMNSLKAEDTAVYYCARGFPLLRHGAMDYWG QGTLVTVSSGGGGSGGGGSGGGGSDIQMTQSPSSLSAS VGDRVTITCKASQNVDTNVAWYQQKPGQAPKSLIYSAS YVYWDVPSRFSGSASGTDFTLTISSVQSEDFATYYCQQ YDQQLITFGCGTKLEIKSGGGGSEVQLVESGGGLVQPG GSLKLSCAASGFTFNKYAMNWVRQAPGKGLEWVARIR SKYNNYATYYADSVKDRFTISRDDSKNTAYLQMNNLK TEDTAVYYCVRHGNFGNSYISYWAYCGQGTLVTVSSG GGGSGGGGSGGGGSQTVVTQEPSLTVSPGGTVTLTCGS STGAVTSGNYPNWVQQKPGQCPRGLIGGTKFLAPGTPA RFSGSLLGGKAALTLSGVQPEDEAEYYCVLWYSNRWV FGGGTKLTVLGGGGDKTHTCPPCPAPELLGGPSVFLFPP KPKDTLMISRTPEVTCVVVDVSHEDPEVKFNWYVDGV EVHNAKTKPCEEQYGSTYRCVSVLTVLHQDWLNGKEY KCKVSNKALPAPIEKTISKAKGQPREPQVYTLPPSREEM TKNQVSLTCLVKGFYPSDIAVEWESNGQPENNYKTTPP VLDSDGSFFLYSKLTVDKSRWQQGNVFSCSVMHEALH NHYTQKSLSLSPGKGGGGSGGGGSGGGGSGGGGSGGG GSGGGGSDKTHTCPPCPAPELLGGPSVFLFPPKPKDTLM ISRTPEVTCVVVDVSHEDPEVKFNWYVDGVEVHNAKT |

TABLE 15-continued

BiTE Molecule Sequences.

| DESCRIPTION | SEQUENCE |
|---|---|
| | KPCEEQYGSTYRCVSVLTVLHQDWLNGKEYKCKVSNK<br>ALPAPIEKTISKAKGQPREPQVYTLPPSREEMTKNQVSL<br>TCLVKGFYPSDIAVEWESNGQPENNYKTTPPVLDSDGS<br>FFLYSKLTVDKSRWQQGNVFSCSVMHEALHNHYTQKS<br>LSLSPGK |
| 240 PM76-B10.11 x CD3 -<br>scFc_ bispecific<br>HLE molecule (with<br>cys-clamp; second cys<br>clamp at CD3 103/43-) | QVQLVESGGGLVKPGESLRLSCAASGFTFSDYYMYWV<br>RQAPGKCLEWVAIISDGGYYTYYSDIIKGRFTISRDNAK<br>NSLYLQMNSLKAEDTAVYYCARGFPLLRHGAMDYWG<br>QGTLVTVSSGGGGSGGGGSGGGGSDIQMTQSPSSLSAS<br>VGDRVTITCKASQNVDTNVAWYQQKPGQAPKSLIYSAS<br>YVYWDVPSRFSGSASGTDFTLTISSVQSEDFATYYCQQ<br>YDQQLITFGCGTKLEIKSGGGGSEVQLVESGGGLVQPG<br>GSLKLSCAASGFTFNKYAMNWVRQAPGKGLEWVARIR<br>SKYNNYATYYADSVKDRFTISRDDSKNTAYLQMNNLK<br>TEDTAVYYCVRHGNFGNSYISYWAYCGQGTLVTVSSG<br>GGGSGGGGSGGGGSQTVVTQEPSLTVSPGGTVTLTCGS<br>STGAVTSGNYPNWVQQKPGQCPRGLIGGTKFLAPGTPA<br>RFSGSLLGGKAALTLSGVQPEDEAEYYCVLWYSNRWV<br>FGGGTKLTVLGGGGDKTHTCPPCPAPELLGGPSVFLFPP<br>KPKDTLMISRTPEVTCVVVDVSHEDPEVKFNWYVDGV<br>EVHNAKTKPCEEQYGSTYRCVSVLTVLHQDWLNGKEY<br>KCKVSNKALPAPIEKTISKAKGQPREPQVYTLPPSREEM<br>TKNQVSLTCLVKGFYPSDIAVEWESNGQPENNYKTTPP<br>VLDSDGSFFLYSKLTVDKSRWQQGNVFSCSVMHEALH<br>NHYTQKSLSLSPGGGGSGGGGSGGGGSGGGGSGGGGS<br>GGGGSDKTHTCPPCPAPELLGGPSVFLFPPKPKDTLMIS<br>RTPEVTCVVVDVSHEDPEVKFNWYVDGVEVHNAKTKP<br>CEEQYGSTYRCVSVLTVLHQDWLNGKEYKCKVSNKAL<br>PAPIEKTISKAKGQPREPQVYTLPPSREEMTKNQVSLTC<br>LVKGFYPSDIAVEWESNGQPENNYKTTPPVLDSDGSFFL<br>YSKLTVDKSRWQQGNVFSCSVMHEALHNHYTQKSLSL<br>SPGK |
| CD70 | |
| 241 Anti-CD70 CDR-H1 | TYAMS |
| 242 Anti-CD70 CDR-H2 | AISGSGGRTFYAESVEG |
| 243 Anti-CD70 CDR-H3 | HDYSNYPYFDY |
| 244 Anti-CD70 CDR-L1 | RASQSVRSTYLA |
| 245 Anti-CD70 CDR-L2 | GASSRAT |
| 246 Anti-CD70 CDR-L3 | QQYGDLPFT |
| 247 Anti-CD70 VH | EVQLLESGGGMVQPGGSLRLSCAASGFTFSTYAMSWV<br>RQAPGKCLEWVSAISGSGGRTFYAESVEGRFTISRDNSK<br>NTLYLQMNSLRAEDTAVYYCAKHDYSNYPYFDYWGQ<br>GTLVTVSS |
| 248 Anti-CD70 VL | EIVLTQSPGTLSLSPGERATLSCRASQSVRSTYLAWYQQ<br>K<br>PGQAPRLLIYGASSRATGIPDRFSGSGSGTDFTLTISRLE<br>PEDFAVYSCQQYGDLPFTFGCGTKLEIK |
| 249 Anti-CD70 scFv (cys<br>clamp) | EVQLLESGGGMVQPGGSLRLSCAASGFTFSTYAMSWV<br>RQAPGKCLEWVSAISGSGGRTFYAESVEGRFTISRDNSK<br>NTLYLQMNSLRAEDTAVYYCAKHDYSNYPYFDYWGQ<br>GTLVTVSSGGGGSGGGGSGGGGSEIVLTQSPGTLSLSPG<br>ERATLSCRASQSVRSTYLAWYQQKPGQAPRLLIYGASS<br>RATGIPDRFSGSGSGTDFTLTISRLEPEDFAVYSCQQYGD<br>LPFTFGCGTKLEIK |
| 250 Anti-CD70 VH-VL<br>scFc | EVQLLESGGGMVQPGGSLRLSCAASGFTFSTYAMSWV<br>RQAPGKCLEWVSAISGSGGRTFYAESVEGRFTISRDNSK<br>NTLYLQMNSLRAEDTAVYYCAKHDYSNYPYFDYWGQ<br>GTLVTVSSGGGGSGGGGSGGGGSEIVLTQSPGTLSLSPG<br>ERATLSCRASQSVRSTYLAWYQQKPGQAPRLLIYGASS<br>RATGIPDRFSGSGSGTDFTLTISRLEPEDFAVYSCQQYGD<br>LPFTFGCGTKLEIKSGGGGSEVQLVESGGGLVQPGGSLK<br>LSCAASGFTFNKYAMNWVRQAPGKGLEWVARIRSKYN<br>NYATYYADSVKDRFTISRDDSKNTAYLQMNNLKTEDT<br>AVYYCVRHGNFGNSYISYWAYWGQGTLVTVSSGGGGS<br>GGGGSGGGGSQTVVTQEPSLTVSPGGTVTLTCGSSTGA<br>VTSGNYPNWVQQKPGQAPRGLIGGTKFLAPGTPARFSG<br>SLLGGKAALTLSGVQPEDEAEYYCVLWYSNRWVFGGG<br>TKLTVLGGGGDKTHTCPPCPAPELLGGPSVFLFPPKPKD<br>TLMISRTPEVTCVVVDVSHEDPEVKFNWYVDGVEVHN<br>AKTKPCEEQYGSTYRCVSVLTVLHQDWLNGKEYKCKV<br>SNKALPAPIEKTISKAKGQPREPQVYTLPPSREEMTKNQ<br>VSLTCLVKGFYPSDIAVEWESNGQPENNYKTTPPVLDS<br>DGSFFLYSKLTVDKSRWQQGNVFSCSVMHEALHNHYT<br>QKSLSLSPGKGGGGSGGGGSGGGGSGGGGSGGGGSGG |

TABLE 15-continued

BiTE Molecule Sequences.

| DESCRIPTION | SEQUENCE |
|---|---|
| | GGSDKTHTCPPCPAPELLGGPSVFLFPPKPKDTLMISRTP EVTCVVVDVSHEDPEVKFNWYVDGVEVHNAKTKPCEE QYGSTYRCVSVLTVLHQDWLNGKEYKCKVSNKALPAP IEKTISKAKGQPREPQVYTLPPSREEMTKNQVSLTCLVK GFYPSDIAVEWESNGQPENNYKTTPPVLDSDGSFFLYSK LTVDKSRWQQGNVFSCSVMHEALHNHYTQKSLSLSPG K |

CLDN18.2

| | | |
|---|---|---|
| 251 | VH CDR-H1 CL-1 and CL-2 | GYYMH |
| 252 | VH CDR-H2 | WINPNSGGTKYAQKFQG |
| 253 | VH CDR-H3 | DRITVAGTYYYYGMDV |
| 254 | VL CDR-L1 | RASQGVNNWLA |
| 255 | VL CDR-L2 | TASSLQS |
| 256 | VL CDR-L3 | QQANSFPIT |
| 257 | VH CL-1 | QVQLVQSGAEVKKPGASVKVSCKASGYTFTGYYMHW VRQAPGQCLEWMGWINPNSGGTKYAQKFQGRVTMTR DTSISTAYMELSRLRSDDTAVYYCARDRITVAGTYYYY GMDVWGQGTTVTVSS |
| 258 | VL CL-1 | DIQMTQSPSSVSASVGDRVTITCRASQGVNNWLAWYQ QKPGKAPKLLIYTASSLQSGVPSRFSGSGSGTDFTLTIRS LQPEDFATYYCQQANSFPITFGCGTRLEIK |
| 259 | scFv CL-1 | QVQLVQSGAEVKKPGASVKVSCKASGYTFTGYYMHW VRQAPGQCLEWMGWINPNSGGTKYAQKFQGRVTMTR DTSISTAYMELSRLRSDDTAVYYCARDRITVAGTYYYY GMDVWGQGTTVTVSSGGGGSGGGGSGGGGSDIQMTQ SPSSVSASVGDRVTITCRASQGVNNWLAWYQQKPGKA PKLLIYTASSLQSGVPSRFSGSGSGTDFTLTIRSLQPEDFA TYYCQQANSFPITFGCGTRLEIK |
| 260 | bispecific molecule CL-1 xI2C | QVQLVQSGAEVKKPGASVKVSCKASGYTFTGYYMHW VRQAPGQCLEWMGWINPNSGGTKYAQKFQGRVTMTR DTSISTAYMELSRLRSDDTAVYYCARDRITVAGTYYYY GMDVWGQGTTVTVSSGGGGSGGGGSGGGGSDIQMTQ SPSSVSASVGDRVTITCRASQGVNNWLAWYQQKPGKA PKLLIYTASSLQSGVPSRFSGSGSGTDFTLTIRSLQPEDFA TYYCQQANSFPITFGCGTRLEIKSGGGGSEVQLVESGGG LVQPGGSLKLSCAASGFTFNKYAMNWVRQAPGKGLE WVARIRSKYNNYATYYADSVKDRFTISRDDSKNTAYL QMNNLKTEDTAVYYCVRHGNFGNSYISYWAYWGQGT LVTVSSGGGGSGGGGSGGGGSQTVVTQEPSLTVSPGGT VTLTCGSSTGAVTSGNYPNWVQQKPGQAPRGLIGGTKF LAPGTPARFSGSLLGGKAALTLSGVQPEDEAEYYCVLW YSNRWVFGGGTKLTVL |
| 261 | Bispecific scFc molecule CL-1 xI2C-scFc | QVQLVQSGAEVKKPGASVKVSCKASGYTFTGYYMHW VRQAPGQCLEWMGWINPNSGGTKYAQKFQGRVTMTR DTSISTAYMELSRLRSDDTAVYYCARDRITVAGTYYYY GMDVWGQGTTVTVSSGGGGSGGGGSGGGGSDIQMTQ SPSSVSASVGDRVTITCRASQGVNNWLAWYQQKPGKA PKLLIYTASSLQSGVPSRFSGSGSGTDFTLTIRSLQPEDFA TYYCQQANSFPITFGCGTRLEIKSGGGGSEVQLVESGGG LVQPGGSLKLSCAASGFTFNKYAMNWVRQAPGKGLE WVARIRSKYNNYATYYADSVKDRFTISRDDSKNTAYL QMNNLKTEDTAVYYCVRHGNFGNSYISYWAYWGQGT LVTVSSGGGGSGGGGSGGGGSQTVVTQEPSLTVSPGGT VTLTCGSSTGAVTSGNYPNWVQQKPGQAPRGLIGGTKF LAPGTPARFSGSLLGGKAALTLSGVQPEDEAEYYCVLW YSNRWVFGGGTKLTVLGGGGDKTHTCPPCPAPELLGGP SVFLFPPKPKDTLMISRTPEVTCVVVDVSHEDPEVKFNW YVDGVEVHNAKTKPCEEQYGSTYRCVSVLTVLHQDWL NGKEYKCKVSNKALPAPIEKTISKAKGQPREPQVYTLPP SREEMTKNQVSLTCLVKGFYPSDIAVEWESNGQPENNY KTTPPVLDSDGSFFLYSKLTVDKSRWQQGNVFSCSVMH EALHNHYTQKSLSLSPGKGGGGSGGGGSGGGGSGGGG SGGGGSGGGGSDKTHTCPPCPAPELLGGPSVFLFPPKPK DTLMISRTPEVTCVVVDVSHEDPEVKFNWYVDGVEVH NAKTKPCEEQYGSTYRCVSVLTVLHQDWLNGKEYKCK VSNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHY TQKSLSLSPGK |
| 262 | VH CL-2 | QVQMVQSGAEVKKHGASVKVSCKASGYTFTGYYMHW VRQAPGQCLEWMGWINPNSGGTKYAQKFQGRVTMTR DTSISTAYMELSRLRSDDTAVYYCARDRITVAGTYYYY GMDVWGQGTTVTVSS |

TABLE 15-continued

BiTE Molecule Sequences.

| | DESCRIPTION | SEQUENCE |
|---|---|---|
| 263 | VL CL-2 | DIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIK |
| 264 | scFv CL-2 | QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIK |
| 265 | bispecific molecule CL-2xI2C | QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 266 | Bispecific scFc molecule CL-2xI2C-scFc | QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

MUC17

| | | |
|---|---|---|
| 267 | VH CDR1 MU-2-C2 | NHGMH |
| 268 | VH CDR2 MU-2-C2 | GIWSEGSNKYYADAVKG |
| 269 | VH CDR3 MU-2-C2 | ATYTTGWSYFDY |
| 270 | VL CDR1 MU-2-C2 | SGDKLGDKYAS |
| 271 | VL CDR2 MU-2-C2 | QDAKRPS |
| 272 | VL CDR3 MU-2-C2 | QAFHQSTWV |
| 273 | VH MU-2-C2 | QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSS |
| 274 | VL MU-2-C2 | SYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL |
| 275 | bispecific molecule MU-2-C2 x CD3 - scFc (MUC17 scFv underlined) | <u>QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL</u>SGGGGSEVQLVESGGGLVQPGGSLKLSCAASGFTFNKYAMNWVRQAPGKGLEWVARIRSKYNNYATYYADSVKD |

TABLE 15-continued

BiTE Molecule Sequences.

| DESCRIPTION | SEQUENCE |
|---|---|
| | RFTISRDDSKNTAYLQMNNLKTEDTAVYYCVRHGNFG
NSYISYWAYWGQGTLVTVSSGGGGSGGGGSGGGGSQT
VVTQEPSLTVSPGGTVTLTCGSSTGAVTSGNYPNWVQQ
KPGQAPRGLIGGTKFLAPGTPARFSGSLLGGKAALTLSG
VQPEDEAEYYCVLWYSNRWVFGGGTKLTVL
GGGGDKTHTCPPCPAPELLGGPSVFLFPPKPKDTLMISR
TPEVTCVVVDVSHEDPEVKFNWYVDGVEVHNAKTKPC
EEQYGSTYRCVSVLTVLHQDWLNGKEYKCKVSNKALP
APIEKTISKAKGQPREPQVYTLPPSREEMTKNQVSLTCL
VKGFYPSDIAVEWESNGQPENNYKTTPPVLDSDGSFFL
YSKLTVDKSRWQQGNVFSCSVMHEALHNHYTQKSLSL
SPGKGGGGSGGGGSGGGGSGGGGSGGGGSGGGGSDKT
HTCPPCPAPELLGGPSVFLFPPKPKDTLMISRTPEVTCVV
VDVSHEDPEVKFNWYVDGVEVHNAKTKPCEEQYGSTY
RCVSVLTVLHQDWLNGKEYKCKVSNKALPAPIEKTISK
AKGQPREPQVYTLPPSREEMTKNQVSLTCLVKGFYPSDI
AVEWESNGQPENNYKTTPPVLDSDGSFFLYSKLTVDKS
RWQQGNVFSCSVMHEALHNHYTQKSLSLSPGK |
| 276 VH CDR1 MU-32-G6 | NHAMH |
| 277 VHCDR2 MU-32-G6 | GIWSEGSNKYYAESVKG |
| 278 VH CDR3 MU-32-G6 | ATYTTGWSYFDY |
| 279 VL CDR1 MU-32-G6 | SGDKLGDKYAS |
| 280 VL CDR2 MU-32-G6 | QDRKRPS |
| 281 VL CDR3 MU-32-G6 | QAYDASTWV |
| 282 VH MU-32-G6 | QVQLVESGGGVVQPGRSLRLSCAASGFTFSNHAMHWV
RQAPGKCLEWVAGIWSEGSNKYYAESVKGRFTISRDNS
KNTLYLQMNSLRAEDTAVYYCARATYTTGWSYFDYW
GQGTLVTVSS |
| 283 VL MU-32-G6 | SYELTQPPSVSVSPGQTASITCSGDKLGDKYASWYQQK
SGQSPVLVIYQDRKRPSGIPERFSGSNSGNTATLTISGTQ
AMDEADYYCQAYDASTWVFGCGTQLTVL |
| 284 bispecific molecule MU-32-G6 x CD3 - scFc (MUC17 scFv underlined) | <u>QVQLVESGGGVVQPGRSLRLSCAASGFTFSNHAMHWV
RQAPGKCLEWVAGIWSEGSNKYYAESVKGRFTISRDNS
KNTLYLQMNSLRAEDTAVYYCARATYTTGWSYFDYW
GQGTLVTVSSGGGGSGGGGSGGGGSSYELTQPPSVSVS
PGQTASITCSGDKLGDKYASWYQQKSGQSPVLVIYQDR
KRPSGIPERFSGSNSGNTATLTISGTQAMDEADYYCQAY
DASTWVFGCGTQLTVL</u>
SGGGGSEVQLVESGGGLVQPGGSLKLSCAASGFTFNKY
AMNWVRQAPGKGLEWVARIRSKYNNYATYYADSVKD
RFTISRDDSKNTAYLQMNNLKTEDTAVYYCVRHGNFG
NSYISYWAYWGQGTLVTVSSGGGGSGGGGSGGGGSQT
VVTQEPSLTVSPGGTVTLTCGSSTGAVTSGNYPNWVQQ
KPGQAPRGLIGGTKFLAPGTPARFSGSLLGGKAALTLSG
VQPEDEAEYYCVLWYSNRWVFGGGTKLTVLGGGGDK
THTCPPCPAPELLGGPSVFLFPPKPKDTLMISRTPEVTCV
VVDVSHEDPEVKFNWYVDGVEVHNAKTKPCEEQYGST
YRCVSVLTVLHQDWLNGKEYKCKVSNKALPAPIEKTIS
KAKGQPREPQVYTLPPSREEMTKNQVSLTCLVKGFYPS
DIAVEWESNGQPENNYKTTPPVLDSDGSFFLYSKLTVD
KSRWQQGNVFSCSVMHEALHNHYTQKSLSLSPGKGGG
GSGGGGSGGGGSGGGGSGGGGSGGGGSDKTHTCPPCP
APELLGGPSVFLFPPKPKDTLMISRTPEVTCVVVDVSHE
DPEVKFNWYVDGVEVHNAKTKPCEEQYGSTYRCVSVL
TVLHQDWLNGKEYKCKVSNKALPAPIEKTISKAKGQPR
EPQVYTLPPSREEMTKNQVSLTCLVKGFYPSDIAVEWES
NGQPENNYKTTPPVLDSDGSFFLYSKLTVDKSRWQQGN
VFSCSVMHEALHNHYTQKSLSLSPGK |
| 285 VH CDR1 MU 8-B7 | GYYWS |
| 286 VH CDR2 MU 8-B7 | DIDASGSTKYNPSLKS |
| 287 VH CDR3 MU 8-B7 | KKYSTVWSYFDN |
| 288 VL CDR1 MU 8-B7 | SGDKLGDKYAS |
| 289 VL CDR2 MU 8-B7 | QDRKRPS |
| 290 VL CDR3 MU 8-B7 | QAWGSSTAV |

TABLE 15-continued

BiTE Molecule Sequences.

| | DESCRIPTION | SEQUENCE |
|---|---|---|
| 291 | VH<br>MU 8-B7 | QVQLQQWGAGLLKPSETLSLTCAVYGGSFSGYYWSWI<br>RQPPGKCLEWIGDIDASGSTKYNPSLKSRVTISLDTSKN<br>QFSLKLNSVTAADTAVYFCARKKYSTVWSYFDNWGQG<br>TLVTVSS |
| 292 | VL<br>MU 8-B7 | SYELTQPSSVSVPPGQTASITCSGDKLGDKYASWYQQK<br>PGQSPVLVIYQDRKRPSGVPERFSGSNSGNTATLTISGTQ<br>AMDEADYYCQAWGSSTAVFGCGTKLTVL |
| 293 | bispecific<br>molecule<br>MU 8-B7 x CD3 - scFc<br>(MUC17 scFv<br>underlined) | <u>QVQLQQWGAGLLKPSETLSLTCAVYGGSFSGYYWSWI</u><br><u>RQPPGKCLEWIGDIDASGSTKYNPSLKSRVTISLDTSKN</u><br><u>QFSLKLNSVTAADTAVYFCARKKYSTVWSYFDNWGQG</u><br><u>TLVTVSSGGGGSGGGGSGGGGSSYELTQPSSVSVPPGQ</u><br><u>TASITCSGDKLGDKYASWYQQKPGQSPVLVIYQDRKRP</u><br><u>SGVPERFSGSNSGNTATLTISGTQAMDEADYYCQAWGS</u><br><u>STAVFGCGTKLTVL</u><br>SGGGGSEVQLVESGGGLVQPGGSLKLSCAASGFTFNKY<br>AMNWVRQAPGKGLEWVARIRSKYNNYATYYADSVKD<br>RFTISRDDSKNTAYLQMNNLKTEDTAVYYCVRHGNFG<br>NSYISYWAYWGQTLVTVSSGGGGSGGGGSGGGGSQT<br>VVTQEPSLTVSPGGTVTLTCGSSTGAVTSGNYPNWVQQ<br>KPGQAPRGLIGGTKFLAPGTPARFSGSLLGGKAALTLSG<br>VQPEDEAEYYCVLWYSNRWVFGGGTKLTVLGGGGDK<br>THTCPPCPAPELLGGPSVFLFPPKPKDTLMISRTPEVTCV<br>VVDVSHEDPEVKFNWYVDGVEVHNAKTKPCEEQYGST<br>YRCVSVLTVLHQDWLNGKEYKCKVSNKALPAPIEKTIS<br>KAKGQPREPQVYTLPPSREEMTKNQVSLTCLVKGFYPS<br>DIAVEWESNGQPENNYKTTPPVLDSDGSFFLYSKLTVD<br>KSRWQQGNVFSCSVMHEALHNHYTQKSLSLSPGKGGG<br>GSGGGGSGGGGSGGGGSGGGGSGGGGSDKTHTCPPCP<br>APELLGGPSVFLFPPKPKDTLMISRTPEVTCVVVDVSHE<br>DPEVKFNWYVDGVEVHNAKTKPCEEQYGSTYRCVSVL<br>TVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGN<br>VFSCSVMHEALHNHYTQKSLSLSPGK |
| 294 | VH CDR1<br>MU 1-B6 | GYYWS |
| 295 | VH CDR2<br>MU 1-B6 | DIDYSGSTKYNPSLKS |
| 296 | VH CDR3<br>MU 1-B6 | KKYSTVWSYFDY |
| 297 | VL CDR1<br>MU 1-B6 | SGDKLGDKYAN |
| 298 | VL CDR2<br>MU 1-B6 | HDNKRPS |
| 299 | VL CDR3<br>MU 1-B6 | QAYGISSAV |
| 300 | VH<br>MU 1-B6 | QVQLQQWGAGLLKPSETLSLTCAVYGGSFSGYYWSWI<br>RQPPGKCLEWIGDIDYSGSTKYNPSLKSRVTISLDTSKN<br>QFSLKLNSVTAADTAVYFCARKKYSTVWSYFDYWGQG<br>TLVTVSS |
| 301 | VL<br>MU 1-B6 | SYELTQPASASVSPGQTASITCSGDKLGDKYANWYQQK<br>PGQSPILVIYHDNKRPSGIPERFSGSNSGNTATLTISGTQA<br>MDEADYYCQAYGISSAVFGCGTKLTVL |
| 302 | bispecific<br>molecule<br>MU 1-B6xCD3-scFc<br>(MUC17 scFv<br>underlined) | <u>QVQLQQWGAGLLKPSETLSLTCAVYGGSFSGYYWSWI</u><br><u>RQPPGKCLEWIGDIDYSGSTKYNPSLKSRVTISLDTSKN</u><br><u>QFSLKLNSVTAADTAVYFCARKKYSTVWSYFDYWGQG</u><br><u>TLVTVSSGGGGSGGGGSGGGGSSYELTQPASASVSPGQ</u><br><u>TASITCSGDKLGDKYANWYQQKPGQSPILVIYHDNKRP</u><br><u>SGIPERFSGSNSGNTATLTISGTQAMDEADYYCQAYGIS</u><br><u>SAVFGCGTKLTVL</u><br>SGGGGSEVQLVESGGGLVQPGGSLKLSCAASGFTFNKY<br>AMNWVRQAPGKGLEWVARIRSKYNNYATYYADSVKD<br>RFTISRDDSKNTAYLQMNNLKTEDTAVYYCVRHGNFG<br>NSYISYWAYWGQTLVTVSSGGGGSGGGGSGGGGSQT<br>VVTQEPSLTVSPGGTVTLTCGSSTGAVTSGNYPNWVQQ<br>KPGQAPRGLIGGTKFLAPGTPARFSGSLLGGKAALTLSG<br>VQPEDEAEYYCVLWYSNRWVFGGGTKLTVLGGGGDK<br>THTCPPCPAPELLGGPSVFLFPPKPKDTLMISRTPEVTCV<br>VVDVSHEDPEVKFNWYVDGVEVHNAKTKPCEEQYGST<br>YRCVSVLTVLHQDWLNGKEYKCKVSNKALPAPIEKTIS<br>KAKGQPREPQVYTLPPSREEMTKNQVSLTCLVKGFYPS<br>DIAVEWESNGQPENNYKTTPPVLDSDGSFFLYSKLTVD<br>KSRWQQGNVFSCSVMHEALHNHYTQKSLSLSPGKGGG<br>GSGGGGSGGGGSGGGGSGGGGSGGGGSDKTHTCPPCP<br>APELLGGPSVFLFPPKPKDTLMISRTPEVTCVVVDVSHE<br>DPEVKFNWYVDGVEVHNAKTKPCEEQYGSTYRCVSVL |

TABLE 15-continued

BiTE Molecule Sequences.

| DESCRIPTION | SEQUENCE |
|---|---|
| | TVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGN VFSCSVMHEALHNHYTQKSLSLSPGK |

CDH3

| | | |
|---|---|---|
| 303 | VH CDR1 CDH3 G8A 6-B12 | SYPIN |
| 304 | VH CDR2 CDH3 G8A 6-B12 | VIWTGGGTNYASSVKG |
| 305 | VH CDR3 CDH3 G8A 6-B12 | SRGVYDFDGRGAMDY |
| 306 | VL CDR1 CDH3 G8A 6-B12 | KSSQSLLYSSNQKNYFA |
| 307 | VL CDR2 CDH3 G8A 6-B12 | WASTRES |
| 308 | VL CDR3 CDH3 G8A 6-B12 | QQYYSYPYT |
| 309 | VH CDH3 G8A 6-B12 | EVQLLESGGGLVQPGGSLRLSCAASGFSFSSYPINWVRQ APGKGLEWVGVIWTGGGTNYASSVKGRFTISRDNSKNT VYLQMNSLRAEDTAVYYCAKSRGVYDFDGRGAMDY WGQGTLVTVSS |
| 310 | VL CDH3 G8A 6-B12 | DIVMTQSPDSLAVSLGERATINCKSSQSLLYSSNQKNYF AWYQQKPGQPPKLLIYWASTRESGVPDRFSGSGSGTDF TLTISSLQAEDVAVYYCQQYYSYPYTFGQGTKLEIK |
| 311 | CDH3 G8A 6-B12 scFv | EVQLLESGGGLVQPGGSLRLSCAASGFSFSSYPINWVRQ APGKGLEWVGVIWTGGGTNYASSVKGRFTISRDNSKNT VYLQMNSLRAEDTAVYYCAKSRGVYDFDGRGAMDY WGQGTLVTVSSGGGGSGGGGSGGGGSDIVMTQSPDSL AVSLGERATINCKSSQSLLYSSNQKNYFAWYQQKPGQP PKLLIYWASTRESGVPDRFSGSGSGTDFTLTISSLQAEDV AVYYCQQYYSYPYTFGQGTKLEIK |
| 312 | CDH3 G8A 6-B12x CD3 bispecific molecule | EVQLLESGGGLVQPGGSLRLSCAASGFSFSSYPINWVRQ APGKGLEWVGVIWTGGGTNYASSVKGRFTISRDNSKNT VYLQMNSLRAEDTAVYYCAKSRGVYDFDGRGAMDY WGQGTLVTVSSGGGGSGGGGSGGGGSDIVMTQSPDSL AVSLGERATINCKSSQSLLYSSNQKNYFAWYQQKPGQP PKLLIYWASTRESGVPDRFSGSGSGTDFTLTISSLQAEDV AVYYCQQYYSYPYTFGQGTKLEIKSGGGGSEVQLVESG GGLVQPGGSLKLSCAASGFTFNKYAMNWVRQAPGKGL EWVARIRSKYNNYATYYADSVKDRFTISRDDSKNTAYL QMNNLKTEDTAVYYCVRHGNFGNSYISYWAYWGQGT LVTVSSGGGGSGGGGSGGGGSQTVVTQEPSLTVSPGGT VTLTCGSSTGAVTSGNYPNWVQQKPGQAPRGLIGGTKF LAPGTPARFSGSLLGGKAALTLSGVQPEDEAEYYCVLW YSNRWVFGGGTKLTVL |
| 313 | CDH3 G8A 6-B12x I2C0 bispecific molecule HLE | EVQLLESGGGLVQPGGSLRLSCAASGFSFSSYPINWVRQ APGKGLEWVGVIWTGGGTNYASSVKGRFTISRDNSKNT VYLQMNSLRAEDTAVYYCAKSRGVYDFDGRGAMDY WGQGTLVTVSSGGGGSGGGGSGGGGSDIVMTQSPDSL AVSLGERATINCKSSQSLLYSSNQKNYFAWYQQKPGQP PKLLIYWASTRESGVPDRFSGSGSGTDFTLTISSLQAEDV AVYYCQQYYSYPYTFGQGTKLEIKSGGGGSEVQLVESG GGLVQPGGSLKLSCAASGFTFNKYAMNWVRQAPGKGL EWVARIRSKYNNYATYYADSVKDRFTISRDDSKNTAYL QMNNLKTEDTAVYYCVRHGNFGNSYISYWAYWGQGT LVTVSSGGGGSGGGGSGGGGSQTVVTQEPSLTVSPGGT VTLTCGSSTGAVTSGNYPNWVQQKPGQAPRGLIGGTKF LAPGTPARFSGSLLGGKAALTLSGVQPEDEAEYYCVLW YSNRWVFGGGTKLTVLGGGGDKTHTCPPCPAPELLGGP SVFLFPPKPKDTLMISRTPEVTCVVVDVSHEDPEVKFNW YVDGVEVHNAKTKPCEEQYGSTYRCVSVLTVLHQDWL NGKEYKCKVSNKALPAPIEKTISKAKGQPREPQVYTLPP SREEMTKNQVSLTCLVKGFYPSDIAVEWESNGQPENNY KTTPPVLDSDGSFFLYSKLTVDKSRWQQGNVFSCSVMH EALHNHYTQKSLSLSPGKGGGGSGGGGSGGGGSGGGG SGGGGSGGGGSDKTHTCPPCPAPELLGGPSVFLFPPKPK DTLMISRTPEVTCVVVDVSHEDPEVKFNWYVDGVEVH NAKTKPCEEQYGSTYRCVSVLTVLHQDWLNGKEYKCK VSNKALPAPIEKTISKAKGQPREPQVYTLPPSREEMTKN QVSLTCLVKGFYPSDIAVEWESNGQPENNYKTTPPVLD SDGSFFLYSKLTVDKSRWQQGNVFSCSVMHEALHNHY TQKSLSLSPGK |

TABLE 15-continued

BiTE Molecule Sequences.

| | DESCRIPTION | SEQUENCE |
|---|---|---|
| | | CD19 |
| 314 | CD19 VL CDR1 | KASQSVDYDGDSYLN |
| 315 | CD19 VL CDR2 | DASNLVS |
| 316 | CD19 VL CDR3 | QQSTEDPWT |
| 317 | CD19 VH CDR1 | SYWMN |
| 318 | CD19 VH CDR2 | QIWPGDGDTNYNGKFKG |
| 319 | CD19 VH CDR3 | RETTTVGRYYYAMDY |
| 320 | CD19 VL | DIQLTQSPASLAVSLGQRATISCKASQSVDYDGDSYLN WYQQIPGQPPKLLIYDASNLVSGIPPRFSGSGSGTDFTLN IHPVEKVDAATYHCQQSTEDPWTFGGGTKLEIK |
| 321 | CD19 VH | QVQLQQSGAELVRPGSSVKISCKASGYAFSSYWMNWV KQRPGQGLEWIGQIWPGDGDTNYNGKFKGKATLTADE SSSTAYMQLSSLASEDSAVYFCARRETTTVGRYYYAMD YWGQGTTVTVSS |
| 322 | CD19 scFv | DIQLTQSPASLAVSLGQRATISCKASQSVDYDGDSYLN WYQQIPGQPPKLLIYDASNLVSGIPPRFSGSGSGTDFTLN IHPVEKVDAATYHCQQSTEDPWTFGGGTKLEIKGGGGS GGGGSGGGGSQVQLQQSGAELVRPGSSVKISCKASGYA FSSYWMNWVKQRPGQGLEWIGQIWPGDGDTNYNGKF KGKATLTADESSSTAYMQLSSLASEDSAVYFCARRETT TVGRYYYAMDYWGQGTTVTVSS |
| 323 | CD3 VH CDR1 | RYTMH |
| 324 | CD3 VH CDR2 | YINPSRGYTNYNQKFKD |
| 325 | CD3 VH CDR3 | YYDDHYCLDY |
| 326 | CD3 VL CDR1 | RASSSVSYMN |
| 327 | CD3 VL CDR2 | DTSKVAS |
| 328 | CD3 VL CDR3 | QQWSSNPLT |
| 329 | CD3 VH | DIKLQQSGAELARPGASVKMSCKTSGYTFTRYTMHWV KQRPGQGLEWIGYINPSRGYTNYNQKFKDKATLTTDKS SSTAYMQLSSLTSEDSAVYYCARYYDDHYCLDYWGQG TTLTVSS |
| 330 | CD3 VL | VDDIQLTQSPAIMSASPGEKVTMTCRASSSVSYMNWYQ QKSGTSPKRWIYDTSKVASGVPYRFSGSGSGTSYSLTISS MEAEDAATYYCQQWSSNPLTFGAGTKLELK |
| 331 | CD3 scFv | DIKLQQSGAELARPGASVKMSCKTSGYTFTRYTMHWV KQRPGQGLEWIGYINPSRGYTNYNQKFKDKATLTTDKS SSTAYMQLSSLTSEDSAVYYCARYYDDHYCLDYWGQG TTLTVSSVEGGSGGSGGSGGSGGVDDIQLTQSPAIMSAS PGEKVTMTCRASSSVSYMNWYQQKSGTSPKRWIYDTS KVASGVPYRFSGSGSGTSYSLTISSMEAEDAATYYCQQ WSSNPLTFGAGTKLELK |
| 332 | CD19xCD3 scFv incl linker and his-tag | DIQLTQSPASLAVSLGQRATISCKASQSVDYDGDSYLN WYQQIPGQPPKLLIYDASNLVSGIPPRFSGSGSGTDFTLN IHPVEKVDAATYHCQQSTEDPWTFGGGTKLEIKGGGGS GGGGSGGGGSQVQLQQSGAELVRPGSSVKISCKASGYA FSSYWMNWVKQRPGQGLEWIGQIWPGDGDTNYNGKF KGKATLTADESSSTAYMQLSSLASEDSAVYFCARRETT TVGRYYYAMDYWGQGTTVTVSSGGGGSDIKLQQSGAE LARPGASVKMSCKTSGYTFTRYTMHWVKQRPGQGLE WIGYINPSRGYTNYNQKFKDKATLTTDKSSSTAYMQLS SLTSEDSAVYYCARYYDDHYCLDYWGQGTTLTVSSVE GGSGGSGGSGGSGGVDDIQLTQSPAIMSASPGEKVTMT CRASSSVSYMNWYQQKSGTSPKRWIYDTSKVASGVPY RFSGSGSGTSYSLTISSMEAEDAATYYCQQWSSNPLTFG AGTKLELKHHHHHH |
| 333 | Peptide linker | GGGG |
| 334 | Peptide linker | GGGGS |
| 335 | Peptide linker | GGGGQ |
| 336 | Peptide linker | PGGGGS |
| 337 | Peptide linker | PGGDGS |
| 338 | Peptide linker | SGGGGS |
| 339 | Peptide linker | GGGGSGGGS |
| 340 | Peptide linker | GGGGSGGGGS |
| 341 | Peptide linker | GGGGSGGGGSGGGGS |
| 342 | Peptide linker | (GGGGS)x, x = 1, 2, 3, or 4 |
| 343 | Histidine tag | HHHHHH |
| 344 | scFc 1 | DKTHTCPPCP APELLGGPSV FLFPPKPKDT LMISRTPEVT CVVVDVSHED PEVKFNWYVD GVEVHNAKTK PCEEQYGSTY RCVSVLTVLH QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGKGGG GSGGGGSGGGG |

TABLE 15-continued

BiTE Molecule Sequences.

| DESCRIPTION | SEQUENCE |
|---|---|
| 345 scFc 2 | GSGGGGSGGG GSGGGGSDKT HTCPPCPAPE LLGGPSVFLF PPKPKDTLMI SRTPEVTCVV VDVSHEDPEV KFNWYVDGVE VHNAKTKPCE EQYGSTYRCV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK DKTHTCPPCP APELLGGPSV FLFPPKPKDT LMISRTPEVT CVVVDVSHED PEVKFNWYVD GVEVHNAKTK PCEEQYGSTY RCVSVLTVLH QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGGGGS GGGGSGGGGS GGGGSGGGGS GGGGSDKTHT CPPCPAPELL GGPSVFLFPP KPKDTLMISR TPEVTCVVVD VSHEDPEVKF NWYVDGVEVH NAKTKPCEEQ YGSTYRCVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK |

TABLE 16

Exemplary sequences of anti-CCR8 antibodies of the present invention.

| SEQ ID NO. | Description | Sequence |
|---|---|---|
| 346 | Antibody 1 IgG1 HCDR1 | NARMG |
| 347 | Antibody 1 IgG1 HCDR2 | RIKSKTEGGTRDYAAPVKG |
| 348 | Antibody 1 IgG1 HCDR3 | YSGV |
| 349 | Antibody 1 IgG1 LCDR1 | KSSQSVLYSSNNKNYLA |
| 350 | Antibody 1 IgG1 LCDR2 | WASTRES |
| 351 | Antibody 1 IgG1 LCDR3 | QQYYSIPIT |
| 352 | Antibody 1 IgG1 HCVR | EVQLVESGGGLVKPGGSLRLSCAASGFTFSNARM GWVRQAPGKGLEWVGRIKSKTEGGTRDYAAPVKG RFTISRDDSKNTLYLQMNSLKTEDTAVYYCTSYS GVWGQGTMVTVSS |
| 353 | Antibody 1 IgG1 LCVR | DIVMTQSPDSLAVSLGERATINCKSSQSVLYSSN NKNYLAWYHQKPGQSPKLLISWASTRESGVPDRF SGSGSGTDFTLTINSLQAEDVAVYYCQQYYSIPI TFGGGTKVEIKR |
| 354 | Antibody 1 IgG1 HC | EVQLVESGGGLVKPGGSLRLSCAASGFTFSNARM GWVRQAPGKGLEWVGRIKSKTEGGTRDYAAPVKG RFTISRDDSKNTLYLQMNSLKTEDTAVYYCTSYS GVWGQGTMVTVSSASTKGPSVFPLAPSSKSTSGG TAALGCLVKDYFPEPVTVSWNSGALTSGVHTFPA VLQSSGLYSLSSVVTVPSSSLGTQTYICNVNHKP SNTKVDKKVEPKSCDKTHTCPPCPAPELLGGPSV FLFPPKPKDTLMISRTPEVTCVVVDVSHEDPEVK FNWYVDGVEVHNAKTKPREEQYNSTYRVVSVLTV LHQDWLNGKEYKCKVSNKALPAPIEKTISKAKGQ PREPQVYTLPPSREEMTKNQVSLTCLVKGFYPSD IAVEWESNGQPENNYKTTPPVLDSDGSFFLYSKL TVDKSRWQQGNVFSCSVMHEALHNHYTQKSLSLS PGK |
| 355 | Antibody 1 IgG1 LC | DIVMTQSPDSLAVSLGERATINCKSSQSVLYSSN NKNYLAWYHQKPGQSPKLLISWASTRESGVPDRF SGSGSGTDFTLTINSLQAEDVAVYYCQQYYSIPI |

TABLE 16-continued

Exemplary sequences of anti-CCR8 antibodies of the present invention.

| SEQ ID NO. | Description | Sequence |
|---|---|---|
| | | TFGGGTKVEIKRTVAAPSVFIFPPSDEQLKSGTA SVVCLLNNFYPREAKVQWKVDNALQSGNSQESVT EQDSKDSTYSLSSTLTLSKADYEKHKVYACEVTH QGLSSPVTKSFNRGEC |
| 356 | Antibody 1.1 IgG1 (LC: H45Q_S51P) HCDR1 | NARMG |
| 357 | Antibody 1.1 IgG1 (LC: H45Q_S51P) HCDR2 | RIKSKTEGGTRDYAAPVKG |
| 358 | Antibody 1.1 IgG1 (LC: H45Q_S51P) HCDR3 | YSGV |
| 359 | Antibody 1.1 IgG1 (LC: H45Q_S51P) LCDR1 | KSSQSVLYSSNNKNYLA |
| 360 | Antibody 1.1 IgG1 (LC: H45Q_S51P) LCDR2 | WASTRES |
| 361 | Antibody 1.1 IgG1 (LC: H45Q_S51P) LCDR3 | QQYYSIPIT |
| 362 | Antibody 1.1 IgG1 (LC: H45Q_S51P) HCVR | EVQLVESGGGLVKPGGSLRLSCAASGFTFSNARM GWVRQAPGKGLEWVGRIKSKTEGGTRDYAAPVKG RFTISRDDSKNTLYLQMNSLKTEDTAVYYCTSYS GVWGQGTMVTVSS |
| 363 | Antibody 1.1 IgG1 (LC: H45Q_S51P) LCVR | DIVMTQSPDSLAVSLGERATINCKSSQSVLYSSN NKNYLAWYQQKPGQPPKLLISWASTRESGVPDRF SGSGSGTDFTLTINSLQAEDVAVYYCQQYYSIPI TFGGGTKVEIKR |
| 364 | Antibody 1.1 IgG1 (LC: H45Q_S51P) HC | EVQLVESGGGLVKPGGSLRLSCAASGFTFSNARM GWVRQAPGKGLEWVGRIKSKTEGGTRDYAAPVKG RFTISRDDSKNTLYLQMNSLKTEDTAVYYCTSYS GVWGQGTMVTVSSASTKGPSVFPLAPSSKSTSGG TAALGCLVKDYFPEPVTVSWNSGALTSGVHTFPA VLQSSGLYSLSSVVTVPSSSLGTQTYICNVNHKP SNTKVDKKVEPKSCDKTHTCPPCPAPELLGGPSV FLFPPKPKDTLMISRTPEVTCVVVDVSHEDPEVK FNWYVDGVEVHNAKTKPREEQYNSTYRVVSVLTV LHQDWLNGKEYKCKVSNKALPAPIEKTISKAKGQ PREPQVYTLPPSREEMTKNQVSLTCLVKGFYPSD IAVEWESNGQPENNYKTTPPVLDSDGSFFLYSKL TVDKSRWQQGNVFSCSVMHEALHNHYTQKSLSLS PGK |
| 365 | Antibody 1.1 IgG1 (LC: H45Q_S51P) LC | DIVMTQSPDSLAVSLGERATINCKSSQSVLYSSN NKNYLAWYQQKPGQPPKLLISWASTRESGVPDRF SGSGSGTDFTLTINSLQAEDVAVYYCQQYYSIPI TFGGGTKVEIKRTVAAPSVFIFPPSDEQLKSGTA SVVCLLNNFYPREAKVQWKVDNALQSGNSQESVT EQDSKDSTYSLSSTLTLSKADYEKHKVYACEVTH QGLSSPVTKSFNRGEC |
| 366 | Antibody 2.1 IgG1 HCDR1 (LC: F2I_P51S_H53Q_L103V_N148K, HC: K87N_S94N_V98A)(LC: Y25A_ S26A, HC: A71I_D72R) | NYGMH |
| 367 | Antibody 2.1 IgG1 HCDR2 (LC: F2I_P51S_H53Q_L103V_N148K, HC: K87N_S94N_V98A)(LC: Y25A_ S26A, HC: A71I_D72R) | VISYDGSNKFYIRSVKG |
| 368 | Antibody 2.1 IgG1 HCDR3 (LC: F2I_P51S_H53Q_L103V_N148K, HC: K87N_S94N_V98A)(LC: Y25A_ S26A, HC: A71I_D72R) | AGGIGRFDY |
| 369 | Antibody 2.1 IgG1 LCDR1 (LC: F2I_P51S_H53Q_L103V_N148K, HC: K87N_S94N_V98A)(LC: Y25A_ S26A, HC: A71I_D72R) | KAAQSLLHSDGKTYLF |

TABLE 16-continued

Exemplary sequences of anti-CCR8 antibodies of the present invention.

| SEQ ID NO. | Description | Sequence |
|---|---|---|
| 370 | Antibody 2.1 IgG1 LCDR2 (LC: F2I_P51S_H53Q_L103V_N148K, HC: K87N_S94N_V98A)(LC: Y25A_S26A, HC: A71I_D72R) | EVSNRFS |
| 371 | Antibody 2.1 IgG1 LCDR3 (LC: F2I_P51S_H53Q_L103V_N148K, HC: K87N_S94N_V98A)(LC: Y25A_S26A, HC: A71I_D72R) | MQTLKLPLT |
| 372 | Antibody 2.1 IgG1 HCVR (LC: F2I_P51S_H53Q_L103V_N148K, HC: K87N_S94N_V98A)(LC: Y25A_S26A, HC: A71I_D72R) | QVQLVESGGGVVQPGRSLRLSCAASGFTFSNYGM HWVRQAPGKGLEWVAVISYDGSNKFYIRSVKGRF TISRDNSKNTLYLQMNSLRAEDTAVYYCARAGGI GRFDYWGQGTLVTVSS |
| 373 | Antibody 2.1 IgG1 LCVR (LC: F2I_P51S_H53Q_L103V_N148K, HC: K87N_S94N_V98A)(LC: Y25A_S26A, HC: A71I_D72R) | DIVMTQTPLSLSVTPGQPASISCKAAQSLLHSDG KTYLFWYLQKPGQSPQLLIYEVSNRFSGVPDRFS GSGSGTDFTLKISRVEAEDVGVYYCMQTLKLPLT FGGGTKVEIKR |
| 374 | Antibody 2.1 IgG1 HC (LC: F2I_P51S_H53Q_L103V_N148K, HC: K87N_S94N_V98A)(LC: Y25A_S26A, HC: A71I_D72R) | QVQLVESGGGVVQPGRSLRLSCAASGFTFSNYGM HWVRQAPGKGLEWVAVISYDGSNKFYIRSVKGRF TISRDNSKNTLYLQMNSLRAEDTAVYYCARAGGI GRFDYWGQGTLVTVSSASTKGPSVFPLAPSSKST SGGTAALGCLVKDYFPEPVTVSWNSGALTSGVHT FPAVLQSSGLYSLSSVVTVPSSSLGTQTYICNVN HKPSNTKVDKKVEPKSCDKTHTCPPCPAPELLGG PSVFLFPPKPKDTLMISRTPEVTCVVVDVSHEDP EVKFNWYVDGVEVHNAKTKPREEQYNSTYRVVSV LTVLHQDWLNGKEYKCKVSNKALPAPIEKTISKA KGQPREPQVYTLPPSREEMTKNQVSLTCLVKGFY PSDIAVEWESNGQPENNYKTTPPVLDSDGSFFLY SKLTVDKSRWQQGNVFSCSVMHEALHNHYTQKSL SLSPGK |
| 375 | Antibody 2.1 IgG1 LC (LC: F2I_P51S_H53Q_L103V_N148K, HC: K87N_S94N_V98A)(LC: Y25A_S26A, HC: A71I_D72R) | DIVMTQTPLSLSVTPGQPASISCKAAQSLLHSDG KTYLFWYLQKPGQSPQLLIYEVSNRFSGVPDRFS GSGSGTDFTLKISRVEAEDVGVYYCMQTLKLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 376 | Antibody 2.2 IgG1 HCDR1 (LC: F2I_P51S_H53Q_L103V_N148K, HC: K87N_S94N_V98A)(LC: Y25A, HC: A71L_D72K) | NYGMH |
| 377 | Antibody 2.2 IgG1 HCDR2 (LC: F2I_P51S_H53Q_L103V_N148K, HC: K87N_S94N_V98A)(LC: Y25A, HC: A71L_D72K) | VISYDGSNKFYLKSVKG |
| 378 | Antibody 2.2 IgG1 HCDR3 (LC: F2I_P51S_H53Q_L103V_N148K, HC: K87N_S94N_V98A)(LC: Y25A, HC: A71L_D72K) | AGGIGRFDY |
| 379 | Antibody 2.2 IgG1 LCDR1 (LC: F2I_P51S_H53Q_L103V_N148K, HC: K87N_S94N_V98A)(LC: Y25A, HC: A71L_D72K) | KASQSLLHSDGKTYLF |
| 380 | Antibody 2.2 IgG1 LCDR2 (LC: F2I_P51S_H53Q_L103V_N148K, HC: K87N_S94N_V98A)(LC: Y25A, HC: A71L_D72K) | EVSNRFS |
| 381 | Antibody 2.2 IgG1 LCDR3 (LC: F2I_P51S_H53Q_L103V_N148K, HC: K87N_S94N_V98A)(LC: Y25A, HC: A71L_D72K) | MQTLKLPLT |

TABLE 16-continued

Exemplary sequences of anti-CCR8 antibodies of the present invention.

| SEQ ID NO. | Description | Sequence |
|---|---|---|
| 382 | Antibody 2.2 IgG1 HCVR (LC: F2I_P51S_H53Q_L103V_N148K, HC: K87N_S94N_V98A)(LC: Y25A, HC: A71L_D72K) | QVQLVESGGGVVQPGRSLRLSCAASGFTFSNYGM HWVRQAPGKGLEWVAVISYDGSNKFYLKSVKGRF TISRDNSKNTLYLQMNSLRAEDTAVYYCARAGGI GRFDYWGQGTLVTVSS |
| 383 | Antibody 2.2 IgG1 LCVR (LC: F2I_P51S_H53Q_L103V_N148K, HC: K87N_S94N_V98A)(LC: Y25A, HC: A71L_D72K) | DIVMTQTPLSLSVTPGQPASISCKASQSLLHSDG KTYLFWYLQKPGQSPQLLIYEVSNRFSGVPDRFS GSGSGTDFTLKISRVEAEDVGVYYCMQTLKLPLT FGGGTKVEIKR |
| 384 | Antibody 2.2 IgG1 HC (LC: F2I_P51S_H53Q_L103V_N148K, HC: K87N_S94N_V98A)(LC: Y25A, HC: A71L_D72K) | QVQLVESGGGVVQPGRSLRLSCAASGFTFSNYGM HWVRQAPGKGLEWVAVISYDGSNKFYLKSVKGRF TISRDNSKNTLYLQMNSLRAEDTAVYYCARAGGI GRFDYWGQGTLVTVSSASTKGPSVFPLAPSSKST SGGTAALGCLVKDYFPEPVTVSWNSGALTSGVHT FPAVLQSSGLYSLSSWTVPSSSLGTQTYICNVNH KPSNTKVDKKVEPKSCDKTHTCPPCPAPELLGGP SVFLFPPKPKDTLMISRTPEVTCVVVDVSHEDPE VKFNWYVDGVEVHNAKTKPREEQYNSTYRVVSVL TVLHQDWLNGKEYKCKVSNKALPAPIEKTISKAK GQPREPQVYTLPPSREEMTKNQVSLTCLVKGFYP SDIAVEWESNGQPENNYKTTPPVLDSDGSFFLYS KLTVDKSRWQQGNVFSCSVMHEALHNHYTQKSLS LSPGK |
| 385 | Antibody 2.2 IgG1 LC (LC: F2I_P51S_H53Q_L103V_N148K, HC: K87N_S94N_V98A)(LC: Y25A, HC: A71L_D72K) | DIVMTQTPLSLSVTPGQPASISCKASQSLLHSDG KTYLFWYLQKPGQSPQLLIYEVSNRFSGVPDRFS GSGSGTDFTLKISRVEAEDVGVYYCMQTLKLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 386 | Antibody 3.0 IgG1 HCDR1 | NAWMS |
| 387 | Antibody 3.0 IgG1 HCDR2 | RIKRRTDGGTTDYAAPVKD |
| 388 | Antibody 3.0 IgG1 HCDR3 | VTMVRGVIADY |
| 389 | Antibody 3.0 IgG1 LCDR1 | RASQSVSSGSLA |
| 390 | Antibody 3.0 IgG1 LCDR2 | GASSRAT |
| 391 | Antibody 3.0 IgG1 LCDR3 | QQYGSSRT |
| 392 | Antibody 3.0 IgG1 HCVR | EVQLVESGGGLVKPGGSLRLSCAASGFIFSNAWM SWVRQAPGKGLEWVARIKRRTDGGTTDYAAPVKD RFTISRDDSKNTLFLQMNSLKTEDTAVYYCTTVT MVRGVIADYWGQGTLVTVSS |
| 393 | Antibody 3.0 IgG1 LCVR | EIVLTQSPGTLSLSPGERATLSCRASQSVSSGSL AWYQQKLGQAPRLLIYGASSRATGIPDRFSGSGS GTDFTLTISSLEPEDFAVYYCQQYGSSRTFGQGT KVELKR |
| 394 | Antibody 3.0 IgG1 HC | EVQLVESGGGLVKPGGSLRLSCAASGFIFSNAWM SWVRQAPGKGLEWVARIKRRTDGGTTDYAAPVKD RFTISRDDSKNTLFLQMNSLKTEDTAVYYCTTVT MVRGVIADYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYI CNVNHKPSNTKVDKKVEPKSCDKTHTCPPCPAPE LLGGPSVFLFPPKPKDTLMISRTPEVTCVVVDVS HEDPEVKFNWYVDGVEVHNAKTKPREEQYNSTYR VVSVLTVLHQDWLNGKEYKCKVSNKALPAPIEKT ISKAKGQPREPQVYTLPPSREEMTKNQVSLTCLV KGFYPSDIAVEWESNGQPENNYKTTPPVLDSDGS FFLYSKLTVDKSRWQQGNVFSCSVMHEALHNHYT QKSLSLSPGK |
| 395 | Antibody 3.0 IgG1 LC | EIVLTQSPGTLSLSPGERATLSCRASQSVSSGSL AWYQQKLGQAPRLLIYGASSRATGIPDRFSGSGS GTDFTLTISSLEPEDFAVYYCQQYGSSRTFGQGT |

TABLE 16-continued

Exemplary sequences of anti-CCR8 antibodies of the present invention.

| SEQ ID NO. | Description | Sequence |
|---|---|---|
| | | KVELKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC |
| 396 | Antibody 4.0 IgG1 HCDR1 | NAWMS |
| 397 | Antibody 4.0 IgG1 HCDR2 | RIKRKTDGGTTDYAAPVKG |
| 398 | Antibody 4.0 IgG1 HCDR3 | VTLVRGIIFDY |
| 399 | Antibody 4.0 IgG1 LCDR1 | RVSQSVSSSQLA |
| 400 | Antibody 4.0 IgG1 LCDR2 | GASSRAT |
| 401 | Antibody 4.0 IgG1 LCDR3 | QQYGNSRT |
| 402 | Antibody 4.0 IgG1 HCVR | EVQLVESGGGLVKPGGSLRLSCAASGFIFSNAWM SWVRQAPGKGLEWVGRIKRKTDGGTTDYAAPVKG RFTISRDDSKNTLYLLMNSLKIEDTAVYYCTVVT LVRGIIFDYWGQGTLVTVSS |
| 403 | Antibody 4.0 IgG1 LCVR | EIVLTQSPGTLSLSPGESATLSCRVSQSVSSSQL AWYQQKPGQAPRLLIYGASSRATGIPDRFSGSGS GTDFTLTISRLEPEDFAVYYCQQYGNSRTFGQGT KVEIKR |
| 404 | Antibody 4.0 IgG1 HC | EVQLVESGGGLVKPGGSLRLSCAASGFIFSNAWM SWVRQAPGKGLEWVGRIKRKTDGGTTDYAAPVKG RFTISRDDSKNTLYLLMNSLKIEDTAVYYCTVVT LVRGIIFDYWGQGTLVTVSSASTKGPSVFPLAPS SKSTSGGTAALGCLVKDYFPEPVTVSWNSGALTS GVHTFPAVLQSSGLYSLSSWTVPSSSLGTQTYIC NVNHKPSNTKVDKKVEPKSCDKTHTCPPCPAPEL LGGPSVFLFPPKPKDTLMISRTPEVTCVVVDVSH EDPEVKFNWYVDGVEVHNAKTKPREEQYNSTYRV VSVLTVLHQDWLNGKEYKCKVSNKALPAPIEKTI SKAKGQPREPQVYTLPPSREEMTKNQVSLTCLVK GFYPSDIAVEWESNGQPENNYKTTPPVLDSDGSF FLYSKLTVDKSRWQQGNVFSCSVMHEALHNHYTQ KSLSLSPGK |
| 405 | Antibody 4.0 IgG1 LC | EIVLTQSPGTLSLSPGESATLSCRVSQSVSSSQL AWYQQKPGQAPRLLIYGASSRATGIPDRFSGSGS GTDFTLTISRLEPEDFAVYYCQQYGNSRTFGQGT KVEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC |
| 406 | Antibody 4.1 IgG1 HCDR1 (VH: M41L_S42Q_L111R_V112S, VL: S18R_S136P)_huIgG1z mAb(LC: R18S, HC: G65Q_G66L) | NAWLQ |
| 407 | Antibody 4.1 IgG1 HCDR2 (VH: M41L_S42Q_L111R_V112S, VL: S18R_S136P)_huIgG1z mAb(LC: R18S, HC: G65Q G66L) | RIKRKTDQLTTDYAAPVKG |
| 408 | Antibody 4.1 IgG1 HCDR3 (VH: M41L_S42Q_L111R_V112S, VL: S18R_S136P)_huIgG1z mAb(LC: R18S, HC: G65Q G66L) | VTRSRGIIFDY |
| 409 | Antibody 4.1 IgG1 LCDR1 (VH: M41L_S42Q_L111R_V112S, VL: S18R_S136P)_huIgG1z mAb(LC: R18S, HC: G65Q G66L) | RVSQSVSSSQLA |
| 410 | Antibody 4.1 IgG1 LCDR2 (VH: M41L_S42Q_L111R_V112S, VL: S18R_S136P)_huIgG1z mAb(LC: R18S, HC: G65Q G66L) | GASSRAT |

TABLE 16-continued

Exemplary sequences of anti-CCR8 antibodies of the present invention.

| SEQ ID NO. | Description | Sequence |
|---|---|---|
| 411 | Antibody 4.1 IgG1 LCDR3 (VH: M41L_S42Q_L111R_V112S, VL: S18R_S136P)_huIgG1z mAb(LC: R18S, HC: G65Q_G66L) | QQYGNPRT |
| 412 | Antibody 4.1 IgG1 HCVR (VH: M41L_S42Q_L111R_V112S, VL: S18R_S136P)_huIgG1z mAb(LC: R18S, HC: G65Q_G66L) | EVQLVESGGGLVKPGGSLRLSCAASGFIFSNAWL QWVRQAPGKGLEWVGRIKRKTDQLTTDYAAPVKG RFTISRDDSKNTLYLLMNSLKIEDTAVYYCTVVT RSRGIIFDYWGQGTLVTVSS |
| 413 | Antibody 4.1 IgG1 LCVR (VH: M41L_S42Q_L111R_V112S, VL: S18R_S136P)_huIgG1z mAb(LC: R18S, HC: G65Q_G66L) | EIVLTQSPGTLSLSPGESATLSCRVSQSVSSSQL AWYQQKPGQAPRLLIYGASSRATGIPDRFSGSGS GTDFTLTISRLEPEDFAVYYCQQYGNPRTFGQGT KVEIKR |
| 414 | Antibody 4.1 IgG1 HC (VH: M41L_S42Q_L111R_V112S, VL: S18R_S136P)_huIgG1z mAb(LC: R18S, HC: G65Q_G66L) | EVQLVESGGGLVKPGGSLRLSCAASGFIFSNAWL QWVRQAPGKGLEWVGRIKRKTDQLTTDYAAPVKG RFTISRDDSKNTLYLLMNSLKIEDTAVYYCTVVT RSRGIIFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYI CNVNHKPSNTKVDKKVEPKSCDKTHTCPPCPAPE LLGGPSVFLFPPKPKDTLMISRTPEVTCVVVDVS HEDPEVKFNWYVDGVEVHNAKTKPREEQYNSTYR VVSVLTVLHQDWLNGKEYKCKVSNKALPAPIEKT ISKAKGQPREPQVYTLPPSREEMTKNQVSLTCLV KGFYPSDIAVEWESNGQPENNYKTTPPVLDSDGS FFLYSKLTVDKSRWQQGNVFSCSVMHEALHNHYT QKSLSLSPGK |
| 415 | Antibody 4.1 IgG1 LC (VH: M41L_S42Q_L111R_V112S, VL: S18R_S136P)_huIgG1z mAb(LC: R18S, HC: G65Q_G66L) | EIVLTQSPGTLSLSPGESATLSCRVSQSVSSSQL AWYQQKPGQAPRLLIYGASSRATGIPDRFSGSGS GTDFTLTISRLEPEDFAVYYCQQYGNPRTFGQGT KVEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC |
| 416 | Antibody 4.2 IgG1 HCDR1 (VH: M41L_S42Q_L111R_V112S, VL: S18R_S136P)_huIgG1z mAb(LC: R18S, HC: G65A_G66S) | NAWLQ |
| 417 | Antibody 4.2 IgG1 HCDR2 (VH: M41L_S42Q_L111R_V112S, VL: S18R_S136P)_huIgG1z mAb(LC: R18S, HC: G65A_G66S) | RIKRKTDASTTDYAAPVKG |
| 418 | Antibody 4.2 IgG1 HCDR3 (VH: M41L_S42Q_L111R_V112S, VL: S18R_S136P)_huIgG1z mAb(LC: R18S, HC: G65A_G66S) | VTRSRGIIFDY |
| 419 | Antibody 4.2 IgG1 LCDR1 (VH: M41L_S42Q_L111R_V112S, VL: S18R_S136P)_huIgG1z mAb(LC: R18S, HC: G65A_G66S) | RVSQSVSSSQLA |
| 420 | Antibody 4.2 IgG1 LCDR2 (VH: M41L_S42Q_L111R_V112S, VL: S18R_S136P)_huIgG1z mAb(LC: R18S, HC: G65A_G66S) | GASSRAT |
| 421 | Antibody 4.2 IgG1 LCDR3 (VH: M41L_S42Q_L111R_V112S, VL: S18R_S136P)_huIgG1z mAb(LC: R18S, HC: G65A_G66S) | QQYGNPRT |
| 422 | Antibody 4.2 IgG1 HCVR (VH: M41L_S42Q_L111R_V112S, VL: S18R_S136P)_huIgG1z mAb(LC: R18S, HC: G65A_G66S) | EVQLVESGGGLVKPGGSLRLSCAASGFIFSNAWL QWVRQAPGKGLEWVGRIKRKTDASTTDYAAPVKG RFTISRDDSKNTLYLLMNSLKIEDTAVYYCTVVT RSRGIIFDYWGQGTLVTVSS |

TABLE 16-continued

Exemplary sequences of anti-CCR8 antibodies of the present invention.

| SEQ ID NO. | Description | Sequence |
|---|---|---|
| 423 | Antibody 4.2 IgG1 LCVR (VH: M41L_S42Q_L111R_V112S, VL: S18R_S136P)_huIgG1z mAb(LC: R18S, HC: G65A_G66S) | EIVLTQSPGTLSLSPGESATLSCRVSQSVSSSQL AWYQQKPGQAPRLLIYGASSRATGIPDRFSGSGS GTDFTLTISRLEPEDFAVYYCQQYGNPRTFGQGT KVEIKR |
| 424 | Antibody 4.2 IgG1 HC (VH: M41L_S42Q_L111R_V112S, VL: S18R_S136P)_huIgG1z mAb(LC: R18S, HC: G65A_G66S) | EVQLVESGGGLVKPGGSLRLSCAASGFIFSNAWL QWVRQAPGKGLEWVGRIKRKTDASTTDYAAPVKG RFTISRDDSKNTLYLLMNSLKIEDTAVYYCTVVT RSRGIIFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYI CNVNHKPSNTKVDKKVEPKSCDKTHTCPPCPAPE LLGGPSVFLFPPKPKDTLMISRTPEVTCVVVDVS HEDPEVKFNWYVDGVEVHNAKTKPREEQYNSTYR VVSVLTVLHQDWLNGKEYKCKVSNKALPAPIEKT ISKAKGQPREPQVYTLPPSREEMTKNQVSLTCLV KGFYPSDIAVEWESNGQPENNYKTTPPVLDSDGS FFLYSKLTVDKSRWQQGNVFSCSVMHEALHNHYT QKSLSLSPGK |
| 425 | Antibody 4.2 IgG1 LC (VH: M41L_S42Q_L111R_V112S, VL: S18R_S136P)_huIgG1z mAb(LC: R18S, HC: G65A_G66S) | EIVLTQSPGTLSLSPGESATLSCRVSQSVSSSQL AWYQQKPGQAPRLLIYGASSRATGIPDRFSGSGS GTDFTLTISRLEPEDFAVYYCQQYGNPRTFGQGT KVEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC |
| 426 | Antibody 5.0 IgG1 HCDR1 | SYGMH |
| 427 | Antibody 5.0 IgG1 HCDR2 | VISYDGSNKYYADSVKG |
| 428 | Antibody 5.0 IgG1 HCDR3 | GRYFDWFLFDY |
| 429 | Antibody 5.0 IgG1 LCDR1 | KSSQSLLHSDGKTYLF |
| 430 | Antibody 5.0 IgG1 LCDR2 | EVSNRFS |
| 431 | Antibody 5.0 IgG1 LCDR3 | MQSLRLPLT |
| 432 | Antibody 5.0 IgG1 HCVR | QVQLVESGGGVVQPGRSLRLSCAASGFTFSSYGM HWVRQAPGKGLEWVAVISYDGSNKYYADSVKGRF TISRDNSKNTLYLQMNSLRAEDTAVYYCARGRYF DWFLFDYWGQGTLVTVSS |
| 433 | Antibody 5.0 IgG1 LCVR | DTVMTQTPLSLSVTPGQPASISCKSSQSLLHSDG KTYLFWYLQKPGQPPQLLISEVSNRFSGVPDRFS GSGSGTDFTLKISRVEAEDVGFYYCMQSLRLPLT FGGGTKVEIKR |
| 434 | Antibody 5.0 IgG1 HC | QVQLVESGGGVVQPGRSLRLSCAASGFTFSSYGM HWVRQAPGKGLEWVAVISYDGSNKYYADSVKGRF TISRDNSKNTLYLQMNSLRAEDTAVYYCARGRYF DWFLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 435 | Antibody 5.0 IgG1 LC | DTVMTQTPLSLSVTPGQPASISCKSSQSLLHSDG KTYLFWYLQKPGQPPQLLISEVSNRFSGVPDRFS GSGSGTDFTLKISRVEAEDVGFYYCMQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |

TABLE 16-continued

Exemplary sequences of anti-CCR8 antibodies of the present invention.

| SEQ ID NO. | Description | Sequence |
|---|---|---|
| 436 | Antibody 5.1 IgG1 HCDR1 (VH: F134T, VL: S34R_S57Y_F103V)_ huIgG1z mAb | SYGMH |
| 437 | Antibody 5.1 IgG1 HCDR2 (VH: F134T, VL: S34R_S57Y_F103V)_ huIgG1z mAb | VISYDGSNKYYADSVKG |
| 438 | Antibody 5.1 IgG1 HCDR3 (VH: F134T, VL: S34R_S57Y_F103V)__ huIgG1z mAb | GRYFDWTLFDY |
| 439 | Antibody 5.1 IgG1 LCDR1 (VH: F134T, VL: S34R_S57Y_F103V) huIgG1z mAb | KSSQSLLHRDGKTYLF |
| 440 | Antibody 5.1 IgG1 LCDR2 (VH: F134T, VL: S34R_S57Y_F103V)_ huIgG1z mAb | EVSNRFS |
| 441 | Antibody 5.1 IgG1 LCDR3 (VH: F134T, VL: S34R_S57Y_F103V)_ huIgG1z mAb | MQSLRLPLT |
| 442 | Antibody 5.1 IgG1 HCVR (VH: F134T, VL: S34R_S57Y_F103V)_ huIgG1z mAb | QVQLVESGGGVVQPGRSLRLSCAASGFTFSSYGM HWVRQAPGKGLEWVAVISYDGSNKYYADSVKGRF TISRDNSKNTLYLQMNSLRAEDTAVYYCARGRYF DWTLFDYWGQGTLVTVSS |
| 443 | Antibody 5.1 IgG1 LCVR (VH: F134T, VL: S34R_S57Y_F103V)_ huIgG1z mAb | DTVMTQTPLSLSVTPGQPASISCKSSQSLLHRDG KTYLFWYLQKPGQPPQLLIYEVSNRFSGVPDRFS GSGSGTDFTLKISRVEAEDVGVYYCMQSLRLPLT FGGGTKVEIKR |
| 444 | Antibody 5.1 IgG1 HC (VH: F134T, VL: S34R_S57Y_F103V)_ huIgG1z mAb | QVQLVESGGGVVQPGRSLRLSCAASGFTFSSYGM HWVRQAPGKGLEWVAVISYDGSNKYYADSVKGRF TISRDNSKNTLYLQMNSLRAEDTAVYYCARGRYF DWTLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 445 | Antibody 5.1 IgG1 LC (VH: F134T, VL: S34R_S57Y_F103V)_ huIgG1z mAb | DTVMTQTPLSLSVTPGQPASISCKSSQSLLHRDG KTYLFWYLQKPGQPPQLLIYEVSNRFSGVPDRFS GSGSGTDFTLKISRVEAEDVGVYYCMQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 446 | Antibody 5.2 IgG1 HCDR1 (VH: G40PF134T, VL: S57Y_E58L_ V67R_F103V)_huIgG1z mAb | SYPMH |
| 447 | Antibody 5.2 IgG1 HCDR2 (VH: G40PF134T, VL: S57Y_E58L_ V67R_F103V)_huIgG1z mAb | VISYDGSNKYYADSVKG |
| 448 | Antibody 5.2 IgG1 HCDR3 (VH: G40PF134T, VL: S57_YE58L_ V67R_F103V)_huIgG1z mAb | GRYFDWTLFDY |
| 449 | Antibody 5.2 IgG1 LCDR1 (VH: G40PF134T, VL: S57_YE58L_ V67R_F103V)_huIgG1z mAb | KSSQSLLHSDGKTYLF |

TABLE 16-continued

Exemplary sequences of anti-CCR8 antibodies of the present invention.

| SEQ ID NO. | Description | Sequence |
|---|---|---|
| 450 | Antibody 5.2 IgG1 LCDR2 (VH: G40PF134T, VL: S57_YE58L_V67R_F103V)_huIgG1z mAb | LRSNRFS |
| 451 | Antibody 5.2 IgG1 LCDR3 (VH: G40PF134T, VL: S57_YE58L_V67R_F103V)_huIgG1z mAb | MQSLRLPLT |
| 452 | Antibody 5.2 IgG1 HCVR (VH: G40PF134T, VL: S57Y_E58L_V67R_F103V)_huIgG1z mAb | QVQLVESGGGVVQPGRSLRLSCAASGFTFSSYPM HWVRQAPGKGLEWVAVISYDGSNKYYADSVKGRF TISRDNSKNTLYLQMNSLRAEDTAVYYCARGRYF DWTLFDYWGQGTLVTVSS |
| 453 | Antibody 5.2 IgG1 LCVR (VH: G40PF134T, VL: S57Y_E58L_V67R_F103V)_huIgG1z mAb | DTVMTQTPLSLSVTPGQPASISCKSSQSLLHSDG KTYLFWYLQKPGQPPQLLIYLRSNRFSGVPDRFS GSGSGTDFTLKISRVEAEDVGVYYCMQSLRLPLT FGGGTKVEIKR |
| 454 | Antibody 5.2 IgG1 HC (VH: G40PF134T, VL: S57Y_E58L_V67R_F103V)_huIgG1z mAb | QVQLVESGGGVVQPGRSLRLSCAASGFTFSSYPM HWVRQAPGKGLEWVAVISYDGSNKYYADSVKGRF TISRDNSKNTLYLQMNSLRAEDTAVYYCARGRYF DWTLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 455 | Antibody 5.2 IgG1 LC (VH: G40PF134T, VL: S57_YE58L_V67R_F103V)_huIgG1z mAb | DTVMTQTPLSLSVTPGQPASISCKSSQSLLHSDG KTYLFWYLQKPGQPPQLLIYLRSNRFSGVPDRFS GSGSGTDFTLKISRVEAEDVGVYYCMQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 456 | Antibody 5.3 IgG1 HCDR1 (VH: A71S_D72R, VL: S57Y_E58L_V67S_F103V)_huIgG1z mAb | SYGMH |
| 457 | Antibody 5.3 IgG1 HCDR2 (VH: A71S_D72R, VL: S57Y_E58L_V67S_F103V)_huIgG1z mAb | VISYDGSNKYYSRSVKG |
| 458 | Antibody 5.3 IgG1 HCDR3 (VH: A71S_D72R, VL: S57Y_E58L_V67S_F103V)_huIgG1z mAb | GRYFDWFLFDY |
| 459 | Antibody 5.3 IgG1 LCDR1 (VH: A71S_D72R, VL: S57Y_E58L_V67S_F103V)_huIgG1z mAb | KSSQSLLHSDGKTYLF |
| 460 | Antibody 5.3 IgG1 LCDR2 (VH: A71S_D72R, VL: S57Y_E58L_V67S_F103V)_huIgG1z mAb | LSSNRFS |
| 461 | Antibody 5.3 IgG1 LCDR3 (VH: A71S_D72R, VL: S57Y_E58L_V67S_F103V)_huIgG1z mAb | MQSLRLPLT |
| 462 | Antibody 5.3 IgG1 HCVR (VH: A71S_D72R, VL: S57Y_E58L_V67S_F103V)_huIgG1z mAb | QVQLVESGGGVVQPGRSLRLSCAASGFTFSSYGM HWVRQAPGKGLEWVAVISYDGSNKYYSRSVKGRF TISRDNSKNTLYLQMNSLRAEDTAVYYCARGRYF DWFLFDYWGQGTLVTVSS |
| 463 | Antibody 5.3 IgG1 LCVR (VH: A71S_D72R, VL: S57Y_E58L_V67S_F103V)_huIgG1z mAb | DTVMTQTPLSLSVTPGQPASISCKSSQSLLHSDG KTYLFWYLQKPGQPPQLLIYLSSNRFSGVPDRFS GSGSGTDFTLKISRVEAEDVGVYYCMQSLRLPLT FGGGTKVEIKR |

TABLE 16-continued

Exemplary sequences of anti-CCR8 antibodies of the present invention.

| SEQ ID NO. | Description | Sequence |
|---|---|---|
| 464 | Antibody 5.3 IgG1 HC (VH: A71S_D72R, VL: S57Y_E58L_ V67S_F103V)_huIgG1z mAb | QVQLVESGGGVVQPGRSLRLSCAASGFTFSSYGM HWVRQAPGKGLEWVAVISYDGSNKYYSRSVKGRF TISRDNSKNTLYLQMNSLRAEDTAVYYCARGRYF DWFLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 465 | Antibody 5.3 IgG1 LC (VH: A71S_D72R, VL: S57Y_E58L_ V67S_F103V)_huIgG1z mAb | DTVMTQTPLSLSVTPGQPASISCKSSQSLLHSDG KTYLFWYLQKPGQPPQLLIYLSSNRFSGVPDRFS GSGSGTDFTLKISRVEAEDVGVYYCMQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 466 | Antibody 5.4 IgG1 HCDR1 (VH: G40A, VL: S57Y_E58L_V67T_ F103V)_huIgG1z mAb | SYAMH |
| 467 | Antibody 5.4 IgG1 HCDR2 (VH: G40A, VL: S57Y_E58L_V67T_ F103V)_huIgG1z mAb | VISYDGSNKYYADSVKG |
| 468 | Antibody 5.4 IgG1 HCDR3 (VH: G40A, VL: S57Y_E58L_V67T_ F103V)_huIgG1z mAb | GRYFDWFLFDY |
| 469 | Antibody 5.4 IgG1 LCDR1 (VH: G40A, VL: S57Y_E58L_V67T_ F103V)_huIgG1z mAb | KSSQSLLHSDGKTYLF |
| 470 | Antibody 5.4 IgG1 LCDR2 (VH: G40A, VL: S57Y_E58L_V67T_ F103V)_huIgG1z mAb | LTSNRFS |
| 471 | Antibody 5.4 IgG1 LCDR3 (VH: G40A, VL: S57Y_E58L_V67T_ F103V)_huIgG1z mAb | MQSLRLPLT |
| 472 | Antibody 5.4 IgG1 HCVR (VH: G40A, VL: S57Y_E58L_V67T_ F103V)_huIgG1z mAb | QVQLVESGGGVVQPGRSLRLSCAASGFTFSSYAM HWVRQAPGKGLEWVAVISYDGSNKYYADSVKGRF TISRDNSKNTLYLQMNSLRAEDTAVYYCARGRYF DWFLFDYWGQGTLVTVSS |
| 473 | Antibody 5.4 IgG1 LCVR (VH: G40A, VL: S57Y_E58L_V67T_ F103V)_huIgG1z mAb | DTVMTQTPLSLSVTPGQPASISCKSSQSLLHSDG KTYLFWYLQKPGQPPQLLIYLTSNRFSGVPDRFS GSGSGTDFTLKISRVEAEDVGVYYCMQSLRLPLT FGGGTKVEIKR |
| 474 | Antibody 5.4 IgG1 HC (VH: G40A, VL: S57Y_E58L_V67T_ F103V)_huIgG1z mAb | QVQLVESGGGVVQPGRSLRLSCAASGFTFSSYAM HWVRQAPGKGLEWVAVISYDGSNKYYADSVKGRF TISRDNSKNTLYLQMNSLRAEDTAVYYCARGRYF DWFLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 475 | Antibody 5.4 IgG1 LC (VH: G40A, VL: S57Y_E58L_V67T_ F103V)_huIgG1z mAb | DTVMTQTPLSLSVTPGQPASISCKSSQSLLHSDG KTYLFWYLQKPGQPPQLLIYLTSNRFSGVPDRFS GSGSGTDFTLKISRVEAEDVGVYYCMQSLRLPLT FGGGTKVEIKRTVAAPSVFIFPPSDEQLKSGTAS |

TABLE 16-continued

Exemplary sequences of anti-CCR8 antibodies of the present invention.

| SEQ ID NO. | Description | Sequence |
|---|---|---|
| | | VVCLLNNFYPREAKVQWKVDNALQSGNSQESVTE QDSKDSTYSLSSTLTLSKADYEKHKVYACEVTHQ GLSSPVTKSFNRGEC |
| 476 | Antibody 5.5 IgG1 HCDR1 (VH: G40P_M41V, VL: S57Y_E58L_ V67T_F103V)_huIgG1z mAb | SYPVH |
| 477 | Antibody 5.5 IgG1 HCDR2 (VH: G40P_M41V, VL: S57Y_E58L_ V67T_F103V)_huIgG1z mAb | VISYDGSNKYYADSVKG |
| 478 | Antibody 5.5 IgG1 HCDR3 (VH: G40P_M41V, VL: S57Y_E58L_ V67T_F103V)_huIgG1z mAb | GRYFDWFLFDY |
| 479 | Antibody 5.5 IgG1 LCDR1 (VH: G40P_M41V, VL: S57Y_E58L_ V67T_F103V)_huIgG1z mAb | KSSQSLLHSDGKTYLF |
| 480 | Antibody 5.5 IgG1 LCDR2 (VH: G40P_M41V, VL: S57Y_E58L_ V67T_F103V) huIgG1zmAb | LTSNRFS |
| 481 | Antibody 5.5 IgG1 LCDR3 (VH: G40P_M41V, VL: S57Y_E58L_ V67T_F103V)_huIgG1z mAb | MQSLRLPLT |
| 482 | Antibody 5.5 IgG1 HCVR (VH: G40P_M41V, VL: S57Y_E58L_ V67T_F103V)_huIgG1z mAb | QVQLVESGGGVVQPGRSLRLSCAASGFTFSSYPV HWVRQAPGKGLEWVAVISYDGSNKYYADSVKGRF TISRDNSKNTLYLQMNSLRAEDTAVYYCARGRYF DWFLFDYWGQGTLVTVSS |
| 483 | Antibody 5.5 IgG1 LCVR (VH: G40P_M41V, VL: S57Y_E58L_ V67T_F103V)_huIgG1z mAb | DTVMTQTPLSLSVTPGQPASISCKSSQSLLHSDG KTYLFWYLQKPGQPPQLLIYLTSNRFSGVPDRFS GSGSGTDFTLKISRVEAEDVGVYYCMQSLRLPLT FGGGTKVEIKR |
| 484 | Antibody 5.5 IgG1 HC (VH: G40P_M41V, VL: S57Y_E58L_ V67T_F103V)_huIgG1z mAb | QVQLVESGGGVVQPGRSLRLSCAASGFTFSSYPV HWVRQAPGKGLEWVAVISYDGSNKYYADSVKGRF TISRDNSKNTLYLQMNSLRAEDTAVYYCARGRYF DWFLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 485 | Antibody 5.5 IgG1 LC (VH: G40P_M41V, VL: S57Y_E58L_ V67T_F103V)_huIgG1z mAb | DTVMTQTPLSLSVTPGQPASISCKSSQSLLHSDG KTYLFWYLQKPGQPPQLLIYLTSNRFSGVPDRFS GSGSGTDFTLKISRVEAEDVGVYYCMQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 486 | Antibody 5.6 IgG1 HCDR1 (VH: F134T, VL: S34R_S57Y_F103V)_ huIgG1z mAb(LC: G37A_K38R_M107L) | SYGMH |
| 487 | Antibody 5.6 IgG1 HCDR2 (VH: F134T, VL: S34R_S57Y_F103V)_ huIgG1z mAb(LC: G37A_K38R_M107L) | VISYDGSNKYYADSVKG |
| 488 | Antibody 5.6 IgG1 HCDR3 (VH: F134T, VL: S34R_S57Y_F103V)_ huIgG1z mAb(LC: G37A_K38R_M107L) | GRYFDWTLFDY |

TABLE 16-continued

Exemplary sequences of anti-CCR8 antibodies of the present invention.

| SEQ ID NO. | Description | Sequence |
|---|---|---|
| 489 | Antibody 5.6 IgG1 LCDR1 (VH: F134T, VL: S34R_S57Y_F103V)_huIgG1z mAb(LC: G37A_K38R_M107L) | KSSQSLLHRDARTYLF |
| 490 | Antibody 5.6 IgG1 LCDR2 (VH: F134T, VL: S34R_S57Y_F103V)_huIgG1z mAb(LC: G37A_K38R_M107L) | EVSNRFS |
| 491 | Antibody 5.6 IgG1 LCDR3 (VH: F134T, VL: S34R_S57Y_F103V)_huIgG1z mAb(LC: G37A_K38R_M107L) | LQSLRLPLT |
| 492 | Antibody 5.6 IgG1 HCVR (VH: F134T, VL: S34R_S57Y_F103V)_huIgG1z mAb(LC: G37A_K38R_M107L) | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWTLFDYWGQGTLVTVSS |
| 493 | Antibody 5.6 IgG1 LCVR (VH: F134T, VL: S34R_S57Y_F103V)_huIgG1z mAb(LC: G37A_K38R_M107L) | DTVMTQTPLSLSVTPGQPASISCKSSQSLLHRDARTYLFWYLQKPGQPPQLLIYEVSNRFSGVPDRFSGSGSGTDFTLKISRVEAEDVGVYYCLQSLRLPLTFGGGTKVEIKR |
| 494 | Antibody 5.6 IgG1 HC (VH: F134T, VL: S34R_S57Y_F103V)_huIgG1z mAb(LC: G37A_K38R_M107L) | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWTLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 495 | Antibody 5.6 IgG1 LC (VH: F134T, VL: S34R_S57Y_F103V)_huIgG1z mAb(LC: G37A_K38R_M107L) | DTVMTQTPLSLSVTPGQPASISCKSSQSLLHRDARTYLFWYLQKPGQPPQLLIYEVSNRFSGVPDRFSGSGSGTDFTLKISRVEAEDVGVYYCLQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 496 | Antibody 5.7 IgG1 HCDR1 (VH: A71S_D72R, VL: S57Y_E58L_V67S_F103V)_huIgG1z mAb(LC: G37A_K38R_M107L) | SYGMH |
| 497 | Antibody 5.7 IgG1 HCDR2 (VH: A71S_D72R, VL: S57Y_E58L_V67S_F103V)_huIgG1z mAb(LC: G37A_K38R_M107L) | VISYDGSNKYYSRSVKG |
| 498 | Antibody 5.7 IgG1 HCDR3 (VH: A71S_D72R, VL: S57Y_E58L_V67S_F103V)_huIgG1z mAb(LC: G37A_K38R_M107L) | GRYFDWFLFDY |
| 499 | Antibody 5.7 IgG1 LCDR1 (VH: A71S_D72R, VL: S57Y_E58L_V67S_F103V)_huIgG1z mAb(LC: G37A_K38R_M107L) | KSSQSLLHSDARTYLF |
| 500 | Antibody 5.7 IgG1 LCDR2 (VH: A71S_D72R, VL: S57Y_E58L_V67S_F103V)_huIgG1z mAb(LC: G37A_K38R_M107L) | LSSNRFS |
| 501 | Antibody 5.7 IgG1 LCDR3 (VH: A71S_D72R, VL: S57Y_E58L_ | LQSLRLPLT |

TABLE 16-continued

Exemplary sequences of anti-CCR8 antibodies of the present invention.

| SEQ ID NO. | Description | Sequence |
|---|---|---|
| | V67S_F103V)_huIgG1z mAb(LC: G37A_K38R_M107L) | |
| 502 | Antibody 5.7 IgG1 HCVR (VH: A71S_D72R, VL: S57Y_E58L_ V67S_F103V)_huIgG1z mAb(LC: G37A_K38R_M107L) | QVQLVESGGGVVQPGRSLRLSCAASGFTFSSYGM HWVRQAPGKGLEWVAVISYDGSNKYYSRSVKGRF TISRDNSKNTLYLQMNSLRAEDTAVYYCARGRYF DWFLFDYWGQGTLVTVSS |
| 503 | Antibody 5.7 IgG1 LCVR (VH: A71S_D72R, VL: S57Y_E58L_ V67S_F103V)_huIgG1z mAb(LC: G37A_K38R_M107L) | DTVMTQTPLSLSVTPGQPASISCKSSQSLLHSDA RTYLFWYLQKPGQPPQLLIYLSSNRFSGVPDRFS GSGSGTDFTLKISRVEAEDVGVYYCLQSLRLPLT FGGGTKVEIKR |
| 504 | Antibody 5.7 IgG1 HC (VH: A71S_D72R, VL: S57Y_E58L_ V67S_F103V)_huIgG1z mAb(LC: G37A_K38R_M107L) | QVQLVESGGGVVQPGRSLRLSCAASGFTFSSYGM HWVRQAPGKGLEWVAVISYDGSNKYYSRSVKGRF TISRDNSKNTLYLQMNSLRAEDTAVYYCARGRYF DWFLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 505 | Antibody 5.7 IgG1 LC (VH: A71S_D72R, VL: S57Y_E58L_ V67S_F103V)_huIgG1z mAb(LC: G37A_K38R_M107L) | DTVMTQTPLSLSVTPGQPASISCKSSQSLLHSDA RTYLFWYLQKPGQPPQLLIYLSSNRFSGVPDRFS GSGSGTDFTLKISRVEAEDVGVYYCLQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 506 | Antibody 5.8 IgG1 HCDR1 (VH: G40PF134T, VL: S57Y_E58L_ 67R_F103V)_huIgG1z mAb(LC: G37A_K38R_M107L) | SYPMH |
| 507 | Antibody 5.8 IgG1 HCDR2 (VH: G40PF134T, VL: S57Y_E58L_ V67R_F103V)_huIgG1z mAb(LC: G37A_K38R_M107L) | VISYDGSNKYYADSVKG |
| 508 | Antibody 5.8 IgG1 HCDR3 (VH: G40PF134T, VL: S57Y_E58L_ V67R_F103V)_huIgG1z mAb(LC: G37A_K38R_M107L) | GRYFDWTLFDY |
| 509 | Antibody 5.8 IgG1 LCDR1 (VH: G40PF134T, VL: S57Y_E58L_ V67R_F103V)_huIgG1z mAb(LC: G37A_K38R_M107L) | KSSQSLLHSDARTYLF |
| 510 | Antibody 5.8 IgG1 LCDR2 (VH: G40PF134T, VL: S57Y_E58L_ V67R_F103V)_huIgG1z mAb(LC: G37A_K38R_M107L) | LRSNRFS |
| 511 | Antibody 5.8 IgG1 LCDR3 (VH: G40PF134T, VL: S57Y_E58L_ V67R_F103V)_huIgG1z mAb(LC: G37A_K38R_M107L) | LQSLRLPLT |
| 512 | Antibody 5.8 IgG1 HCVR (VH: G40PF134T, VL: S57Y_E58L_ V67R_F103V)_huIgG1z mAb(LC: G37A_K38R_M107L) | QVQLVESGGGVVQPGRSLRLSCAASGFTFSSYPM HWVRQAPGKGLEWVAVISYDGSNKYYADSVKGRF TISRDNSKNTLYLQMNSLRAEDTAVYYCARGRYF DWTLFDYWGQGTLVTVSS |
| 513 | Antibody 5.8 IgG1 LCVR (VH: G40PF134T, VL: S57Y_E58L_ V67R_F103V)_huIgG1z mAb(LC: G37A_K38R_M107L) | DTVMTQTPLSLSVTPGQPASISCKSSQSLLHSDA RTYLFWYLQKPGQPPQLLIYLRSNRFSGVPDRFS GSGSGTDFTLKISRVEAEDVGVYYCLQSLRLPLT FGGGTKVEIKR |

TABLE 16-continued

Exemplary sequences of anti-CCR8 antibodies of the present invention.

| SEQ ID NO. | Description | Sequence |
|---|---|---|
| 514 | Antibody 5.8 IgG1 HC (VH: G40PF134T, VL: S57Y_E58L_V67R_F103V)_huIgG1z mAb(LC: G37A_K38R_M107L) | QVQLVESGGGVVQPGRSLRLSCAASGFTFSSYPM HWVRQAPGKGLEWVAVISYDGSNKYYADSVKGRF TISRDNSKNTLYLQMNSLRAEDTAVYYCARGRYF DWTLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 515 | Antibody 5.8 IgG1 LC (VH: G40PF134T, VL: S57Y_E58L_V67R_F103V)_huIgG1z mAb(LC: G37A_K38R_M107L) | DTVMTQTPLSLSVTPGQPASISCKSSQSLLHSDA RTYLFWYLQKPGQPPQLLIYLRSNRFSGVPDRFS GSGSGTDFTLKISRVEAEDVGVYYCLQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 516 | Antibody 5.9 IgG1 HCDR1 (VH: G40A, VL: S57Y_E58L_V67T_F103V)_huIgG1z mAb(LC: G37A_K38R_M107L) | SYAMH |
| 517 | Antibody 5.9 IgG1 HCDR2 (VH: G40A, VL: S57Y_E58L_V67T_F103V)_huIgG1z mAb(LC: G37A_K38R_M107L) | VISYDGSNKYYADSVKG |
| 518 | Antibody 5.9 IgG1 HCDR3 (VH: G40A, VL: S57Y_E58L_V67T_F103V)_huIgG1z mAb(LC: G37A_K38R_M107L) | GRYFDWFLFDY |
| 519 | Antibody 5.9 IgG1 LCDR1 (VH: G40A, VL: S57Y_E58L_V67T_F103V)_huIgG1z mAb(LC: G37A_K38R_M107L) | KSSQSLLHSDARTYLF |
| 520 | Antibody 5.9 IgG1 LCDR2 (VH: G40A, VL: S57Y_E58L_V67T_F103V)_huIgG1z mAb(LC: G37A_K38R_M107L) | LTSNRFS |
| 521 | Antibody 5.9 IgG1 LCDR3 (VH: G40A, VL: S57Y_E58L_V67T_F103V)_huIgG1z mAb(LC: G37A_K38R_M107L) | LQSLRLPLT |
| 522 | Antibody 5.9 IgG1 HCVR (VH: G40A, VL: S57Y_E58L_V67T_F103V)_huIgG1z mAb(LC: G37A_K38R_M107L) | QVQLVESGGGVVQPGRSLRLSCAASGFTFSSYAM HWVRQAPGKGLEWVAVISYDGSNKYYADSVKGRF TISRDNSKNTLYLQMNSLRAEDTAVYYCARGRYF DWFLFDYWGQGTLVTVSS |
| 523 | Antibody 5.9 IgG1 LCVR (VH: G40A, VL: S57Y_E58L_V67T_F103V)_huIgG1z mAb(LC: G37A_K38R_M107L) | DTVMTQTPLSLSVTPGQPASISCKSSQSLLHSDA RTYLFWYLQKPGQPPQLLIYLTSNRFSGVPDRFS GSGSGTDFTLKISRVEAEDVGVYYCLQSLRLPLT FGGGTKVEIKR |
| 524 | Antibody 5.9 IgG1 HC (VH: G40A, VL: S57Y_E58L_V67T_F103V)_huIgG1z mAb(LC: G37A_K38R_M107L) | QVQLVESGGGVVQPGRSLRLSCAASGFTFSSYAM HWVRQAPGKGLEWVAVISYDGSNKYYADSVKGRF TISRDNSKNTLYLQMNSLRAEDTAVYYCARGRYF DWFLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS |

TABLE 16-continued

Exemplary sequences of anti-CCR8 antibodies of the present invention.

| SEQ ID NO. | Description | Sequence |
|---|---|---|
| | | KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 525 | Antibody 5.9 IgG1 LC (VH: G40A, VL: S57Y_E58L_V67T_ F103V)_huIgG1z mAb(LC: G37A_K38R_M107L) | DTVMTQTPLSLSVTPGQPASISCKSSQSLLHSDA RTYLFWYLQKPGQPPQLLIYLTSNRFSGVPDRFS GSGSGTDFTLKISRVEAEDVGVYYCLQSLRLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 526 | Antibody 6.0 IgG1 HCDR1 | SYVMH |
| 527 | Antibody 6.0 IgG1 HCDR2 | VISYDGSSQYYTDSVKG |
| 528 | Antibody 6.0 IgG1 HCDR2 | GRLATAILFDY |
| 529 | Antibody 6.0 IgG1 LCDR1 | KSSQSLLYSDGKTYLF |
| 530 | Antibody 6.0 IgG1 LCDR2 | EVSNRFS |
| 531 | Antibody 6.0 IgG1 LCDR3 | MQSIKLPLT |
| 532 | Antibody 6.0 IgG1 HCVR | QVQLVESGGGVVQPGRSLRLSCEASGFTFSSYVM HWVRQAPGKGLEWVSVISYDGSSQYYTDSVKGRF TISRDNSKNTLNLQMNSLRAEDTAVYYCVRGRLA TAILFDYWGQGTLVTVSS |
| 533 | Antibody 6.0 IgG1 LCVR | DILMTQTPLSLSVTPGQPASISCKSSQSLLYSDG KTYLFWYLQRPGQPPQLLIYEVSNRFSGVPDRFS GSGSGTDFTLKISRVEAEDVGIYYCMQSIKLPLT FGGGTKVEIKR |
| 534 | Antibody 6.0 IgG1 HC | QVQLVESGGGVVQPGRSLRLSCEASGFTFSSYVM HWVRQAPGKGLEWVSVISYDGSSQYYTDSVKGRF TISRDNSKNTLNLQMNSLRAEDTAVYYCVRGRLA TAILFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 535 | Antibody 6.0 IgG1 LC | DILMTQTPLSLSVTPGQPASISCKSSQSLLYSDG KTYLFWYLQRPGQPPQLLIYEVSNRFSGVPDRFS GSGSGTDFTLKISRVEAEDVGIYYCMQSIKLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 536 | Antibody 6.1 IgG1 HCDR1 (VH: S67R_A114S_I134P, VL: F71L)_ huIgG1z mAb | SYVMH |
| 537 | Antibody 6.1 IgG1 HCDR2 (VH: S67R_A114S_I134P, VL: F71L)_ huIgG1z mAb | VISYDGSRQYYTDSVKG |
| 538 | Antibody 6.1 IgG1 HCDR3 (VH: S67R_A114S_I134P, VL: F71L)_ huIgG1z mAb | GRLATSPLFDY |
| 539 | Antibody 6.1 IgG1 LCDR1 (VH: S67R_A114S_I134P, VL: F71L)_ huIgG1z mAb | KSSQSLLYSDGKTYLF |

TABLE 16-continued

Exemplary sequences of anti-CCR8 antibodies of the present invention.

| SEQ ID NO. | Description | Sequence |
|---|---|---|
| 540 | Antibody 6.1 IgG1 LCDR2 (VH: S67R_A114S_I134P, VL: F71L)_ huIgG1z mAb | EVSNRLS |
| 541 | Antibody 6.1 IgG1 LCDR3 (VH: S67R_A114S_I134P, VL: F71L)_ huIgG1z mAb | MQSIKLPLT |
| 542 | Antibody 6.1 IgG1 HCVR (VH: S67R_A114S_I134P, VL: F71L)_ huIgG1z mAb | QVQLVESGGGVVQPGRSLRLSCEASGFTFSSYVM HWVRQAPGKGLEWVSVISYDGSRQYYTDSVKGRF TISRDNSKNTLNLQMNSLRAEDTAVYYCVRGRLA TSPLFDYWGQGTLVTVSS |
| 543 | Antibody 6.1 IgG1 LCVR (VH: S67R_A114S_I134P, VL: F71L)_ huIgG1z mAb | DILMTQTPLSLSVTPGQPASISCKSSQSLLYSDG KTYLFWYLQRPGQPPQLLIYEVSNRLSGVPDRFS GSGSGTDFTLKISRVEAEDVGIYYCMQSIKLPLT FGGGTKVEIKR |
| 544 | Antibody 6.1 IgG1 HC (VH: S67R_A114S_I134P, VL: F71L)_ huIgG1z mAb | QVQLVESGGGVVQPGRSLRLSCEASGFTFSSYVM HWVRQAPGKGLEWVSVISYDGSRQYYTDSVKGRF TISRDNSKNTLNLQMNSLRAEDTAVYYCVRGRLA TSPLFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFF LYSKLTVDKSRWQQGNVFSCSVMHEALHNHYTQK SLSLSPGK |
| 545 | Antibody 6.1 IgG1 LC (VH: S67R_A114S_I134P, VL: F71L)_ huIgG1z mAb | DILMTQTPLSLSVTPGQPASISCKSSQSLLYSDG KTYLFWYLQRPGQPPQLLIYEVSNRLSGVPDRFS GSGSGTDFTLKISRVEAEDVGIYYCMQSIKLPLT FGGGTKVEIKRTVAAPSVFIFPPSDEQLKSGTAS VVCLLNNFYPREAKVQWKVDNALQSGNSQESVTE QDSKDSTYSLSSTLTLSKADYEKHKVYACEVTHQ GLSSPVTKSFNRGEC |
| 546 | Antibody 6.2 IgG1 HCDR1 (VH: S67R_Q68A_L135K_F136L, VL: S109T_I110L) huIgG1z mAb | SYVMH |
| 547 | Antibody 6.2 IgG1 HCDR2 (VH: S67R_Q68A_L135K_F136L, VL: S109T_I110L) huIgG1z mAb | VISYDGSRAYYTDSVKG |
| 548 | Antibody 6.2 IgG1 HCDR3 (VH: S67R_Q68A_L135K_F136L, VL: S109T_I110L) huIgG1z mAb | GRLATAIKLDY |
| 549 | Antibody 6.2 IgG1 LCDR1 (VH: S67R_Q68A_L135K_F136L, VL: S109T_I110L) huIgG1z mAb | KSSQSLLYSDGKTYLF |
| 550 | Antibody 6.2 IgG1 LCDR2 (VH: S67R_Q68A_L135K_F136L, VL: S109T_I110L) huIgG1z mAb | EVSNRFS |
| 551 | Antibody 6.2 IgG1 LCDR3 (VH: S67R_Q68A_L135K_F136L, VL: S109T_I110L) huIgG1z mAb | MQTLKLPLT |
| 552 | Antibody 6.2 IgG1 HCVR (VH: S67R_Q68A_L135K_F136L, VL: S109T_I110L)_huIgG1z mAb | QVQLVESGGGVVQPGRSLRLSCEASGFTFSSYVM HWVRQAPGKGLEWVSVISYDGSRAYYTDSVKGRF TISRDNSKNTLNLQMNSLRAEDTAVYYCVRGRLA TAIKLDYWGQGTLVTVSS |
| 553 | Antibody 6.2 IgG1 LCVR (VH: S67R_Q68A_L135K_F136L, VL: S109T_I110L)_huIgG1z mAb | DILMTQTPLSLSVTPGQPASISCKSSQSLLYSDG KTYLFWYLQRPGQPPQLLIYEVSNRFSGVPDRFS GSGSGTDFTLKISRVEAEDVGIYYCMQTLKLPLT FGGGTKVEIKR |

TABLE 16-continued

Exemplary sequences of anti-CCR8 antibodies of the present invention.

| SEQ ID NO. | Description | Sequence |
|---|---|---|
| 554 | Antibody 6.2 IgG1 HC (VH: S67R_Q68A_L135K_F136L, VL: S109T_I110L)_huIgG1z mAb | QVQLVESGGGVVQPGRSLRLSCEASGFTFSSYVMHWVRQAPGKGLEWVSVISYDGSRAYYTDSVKGRFTISRDNSKNTLNLQMNSLRAEDTAVYYCVRGRLATAIKLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 555 | Antibody 6.2 IgG1 LC (VH: S67R_Q68A_L135K_F136L, VL: S109T_I110L)_huIgG1z mAb | DIVMTQTPLSLSVTPGQPASISCKSSQSLLYSDGKTYLFWYLQRPGQPPQLLIYEVSNRFSGVPDRFSGSGSGTDFTLKISRVEAEDVGIYYCMQTLKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

Cynomolgus monkey Mauritian origin T4R CCR8
(SEQ ID NO: 556)
MDYRLDPSMTTMTDYYYPDSLSSPCDGELIQRNDKLLLAVFYCLLFVFS

LLGNSLVILVLVVCKKLRNITDIYLLNLALSDLLFVFSFPFQTYYQLDQ

WVFGTVMCKVVSGFYYIGFYSSMFFITLMSVDRYLAVVHAVYAIKVRTI

RMGTTLSLVVWLTAIMATIPLLVFYQVASEDGVLQCYSFYNQQTLKWKI

FTNFEMNILGLLIPFTIFMFCYIKILHQLKRCQNHNKTKAIRLVLIVVI

ASLLFWVPFNVVLFLTSLHSMHILDGCSISQQLNYATHVTEIISFTHCC

VNPVIYAFVGEKFKKHLSEIFQKSCSHIFIYLGRQMPRESCEKSSSCQQ

HSFRSSSIDYIL

Leader sequence
(SEQ ID NO: 557)
MDMRVPAQLLGLLLLWLRGARC

DNA encoding leader sequence of SEQ ID NO: 557
(SEQ ID NO: 558)
atggacatgagagtgcctgcacagctgctgggcctgctgctgctgtggc tgagaggcgccagatgc Leader sequence
(SEQ ID NO: 559)
MAWALLLLTLLTQGTGSWA DNA encoding leader sequence of SEQ ID NO: 559
(SEQ ID NO: 560)
atggcctgggctctgctgctcctcaccctcctcactcagggcacaggt cctgggcc

TCE1 CCR8 HCDR1
(SEQ ID NO: 561)
NARMG

TCE1 CCR8 HCDR2
(SEQ ID NO: 562)
RIKSKTEGGTRDYAAPVKG

TCE1 CCR8 HCDR3
(SEQ ID NO: 563)
YSGV

TCE1 CCR8 LCDR1
(SEQ ID NO: 564)
KSSQSVLYSSNNKNYLA

TCE1 CCR8 LCDR2
(SEQ ID NO: 565)
WASTRES

TCE1 CCR8 LCDR3
(SEQ ID NO: 566)
QQYYSIPIT

TCE2 CCR8 HCDR1
(SEQ ID NO: 567)
NYGMH

TCE2 CCR8 HCDR2
(SEQ ID NO: 568)
VISYDGSNKFYADSVKG

TCE2 CCR8 HCDR3
(SEQ ID NO: 569)
AGGIGRFDY

TCE2 CCR8 LCDR1
(SEQ ID NO: 570)
KYSQSLLHSDGKTYLF

TCE2 CCR8 LCDR2
(SEQ ID NO: 571)
EVSNRFS

TCE2 CCR8 LCDR3
(SEQ ID NO: 572)
MQTLKLPLT

TABLE 17

Exemplary sequences of HCs without the C-terminal lysine of antibodies of the present invention.

| SEQ ID NO: | Designation | Sequence |
|---|---|---|
| 573 | Antibody 1 IgG1 HC | EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 574 | Antibody 1.1 IgG1 (LC: H45Q_S51P) HC | EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 575 | Antibody 2.1 IgG1 HC (LC: F2I_P51S_H53Q_L103V_N148K, HC: K87N_S94N_V98A)(LC: Y25A_S26A, HC: A71I_D72R) | QVQLVESGGGVVQPGRSLRLSCAASGFTFSNYGMHWVRQAPGKGLEWVAVISYDGSNKFYIRSVKGRFTISRDNSKNTLYLQMNSLRAEDTAVYYCARAGGIGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 576 | Antibody 2.2 IgG1 HC (LC: F2I_P51S_H53Q_L103V_N148K, HC: K87N_S94N_V98A)(LC: Y25A, HC: A71L_D72K) | QVQLVESGGGVVQPGRSLRLSCAASGFTFSNYGMHWVRQAPGKGLEWVAVISYDGSNKFYLKSVKGRFTISRDNSKNTLYLQMNSLRAEDTAVYYCARAGGIGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 577 | Antibody 3.0 IgG1 HC | EVQLVESGGGLVKPGGSLRLSCAASGFIFSNAWMSWVRQAPGKGLEWVARIKRRTDGGTTDYAAPVKDRFTISRDDSKNTLFLQMNSLKTEDTAVYYCTTVTMVRGVIADYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| 578 | Antibody 4.0 IgG1 HC | EVQLVESGGGLVKPGGSLRLSCAASGFIFSNAWMSWVRQAPGKGLEWVGRIKRKTDGGTTDYAAPVKGRFTISRDDSKNTLYLLMNSLKIEDTAVYYCTVVTLVRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |

TABLE 17-continued

Exemplary sequences of HCs without the C-terminal lysine of antibodies of the present invention.

| SEQ ID NO: | Designation | Sequence |
|---|---|---|
| 579 | Antibody 4.1 IgG1 HC (VH: M41L_S42Q_L111R_V112S, VL: S18R_S136P)_huIgG1z mAb(LC: R18S, HC: G65Q_G66L) | EVQLVESGGGLVKPGGSLRLSCAASGFIFSNAWLQWVRQAPGKG LEWVGRIKRKTDQLTTDYAAPVKGRFTISRDDSKNTLYLLMNSL KIEDTAVYYCTVVTRSRGIIFDYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKKV EPKSCDKTHTCPPCPAPELLGGPSVFLFPPKPKDTLMISRTPEV TCVVVDVSHEDPEVKFNWYVDGVEVHNAKTKPREEQYNSTYRVV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHNH YTQKSLSLSPG |
| 580 | Antibody 4.2 IgG1 HC (VH: M41L_S42Q_L111R_V112S, VL: S18R_S136P)_huIgG1z mAb(LC: R18S, HC: G65A_G66S) | EVQLVESGGGLVKPGGSLRLSCAASGFIFSNAWLQWVRQAPGKG LEWVGRIKRKTDASTTDYAAPVKGRFTISRDDSKNTLYLLMNSL KIEDTAVYYCTVVTRSRGIIFDYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKKV EPKSCDKTHTCPPCPAPELLGGPSVFLFPPKPKDTLMISRTPEV TCVVVDVSHEDPEVKFNWYVDGVEVHNAKTKPREEQYNSTYRVV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHNH YTQKSLSLSPG |
| 581 | Antibody 5.0 IgG1 HC | QVQLVESGGGVVQPGRSLRLSCAASGFTFSSYGMHWVRQAPGKG LEWVAVISYDGSNKYYADSVKGRFTISRDNSKNTLYLQMNSLRA EDTAVYYCARGRYFDWFLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 582 | Antibody 5.1 IgG1 HC (VH: F134T, VL: S34R_S57Y_F103V)_huIgG1z mAb | QVQLVESGGGVVQPGRSLRLSCAASGFTFSSYGMHWVRQAPGKG LEWVAVISYDGSNKYYADSVKGRFTISRDNSKNTLYLQMNSLRA EDTAVYYCARGRYFDWTLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 583 | Antibody 5.2 IgG1 HC (VH: G40P_F134T, VL: S57Y_E58L_V67R_F103V)_huIgG1z mAb | QVQLVESGGGVVQPGRSLRLSCAASGFTFSSYPMHWVRQAPGKG LEWVAVISYDGSNKYYADSVKGRFTISRDNSKNTLYLQMNSLRA EDTAVYYCARGRYFDWTLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 584 | Antibody 5.3 IgG1 HC (VH: A71S_D72R, VL: S57Y_E58L_V67S_F103V)_huIgG1z mAb | QVQLVESGGGVVQPGRSLRLSCAASGFTFSSYGMHWVRQAPGKG LEWVAVISYDGSNKYYSRSVKGRFTISRDNSKNTLYLQMNSLRA EDTAVYYCARGRYFDWFLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |

TABLE 17-continued

Exemplary sequences of HCs without the C-terminal lysine
of antibodies of the present invention.

| SEQ ID NO: | Designation | Sequence |
|---|---|---|
| 585 | Antibody 5.4 IgG1 HC (VH: G40A, VL: S57Y_E58L_V67T_F103V)_huIgG1z mAb | QVQLVESGGGVVQPGRSLRLSCAASGFTFSSYAMHWVRQAPGKG LEWVAVISYDGSNKYYADSVKGRFTISRDNSKNTLYLQMNSLRA EDTAVYYCARGRYFDWFLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 586 | Antibody 5.5 IgG1 HC (VH: G40P_M41V, VL: S57Y_E58L_V67T_F103V)_huIgG1z mAb | QVQLVESGGGVVQPGRSLRLSCAASGFTFSSYPVHWVRQAPGKG LEWVAVISYDGSNKYYADSVKGRFTISRDNSKNTLYLQMNSLRA EDTAVYYCARGRYFDWFLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 587 | Antibody 5.6 IgG1 HC (VH: F134T, VL: S34R_S57Y_F103V)_huIgG1z mAb(LC: G37A_K38R_M107L) | QVQLVESGGGVVQPGRSLRLSCAASGFTFSSYGMHWVRQAPGKG LEWVAVISYDGSNKYYADSVKGRFTISRDNSKNTLYLQMNSLRA EDTAVYYCARGRYFDWTLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 588 | Antibody 5.7 IgG1 HC (VH: A71S_D72R, VL: S57Y_E58L_V67S_F103V)_huIgG1z mAb(LC: G37A_K38R_M107L) | QVQLVESGGGVVQPGRSLRLSCAASGFTFSSYGMHWVRQAPGKG LEWVAVISYDGSNKYYSRSVKGRFTISRDNSKNTLYLQMNSLRA EDTAVYYCARGRYFDWFLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 589 | Antibody 5.8 IgG1 HC (VH: G40P_F134T, VL: S57Y_E58L_V67R_F103V)_huIgG1z mAb(LC: G37A_K38R_M107L) | QVQLVESGGGVVQPGRSLRLSCAASGFTFSSYPMHWVRQAPGKG LEWVAVISYDGSNKYYADSVKGRFTISRDNSKNTLYLQMNSLRA EDTAVYYCARGRYFDWTLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 590 | Antibody 5.9 IgG1 HC (VH: G40A, VL: S57Y_E58L_V67T_F103V)_huIgG1z mAb(LC: G37A_K38R_M107L) | QVQLVESGGGVVQPGRSLRLSCAASGFTFSSYAMHWVRQAPGKG LEWVAVISYDGSNKYYADSVKGRFTISRDNSKNTLYLQMNSLRA EDTAVYYCARGRYFDWFLFDYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVY TLPPSREEMTKNQVSLTCLVKGFYPSDIAVEWESNGQPENNYKT TPPVLDSDGSFFLYSKLTVDKSRWQQGNVFSCSVMHEALHNHYT QKSLSLSPG |
| 591 | Antibody 6.0 IgG1 HC | QVQLVESGGGVVQPGRSLRLSCEASGFTFSSYVMHWVRQAPGKG LEWVSVISYDGSSQYYTDSVKGRFTISRDNSKNTLNLQMNSLRA |

TABLE 17-continued

Exemplary sequences of HCs without the C-terminal lysine
of antibodies of the present invention.

| SEQ ID NO: | Designation | Sequence |
|---|---|---|
| | | EDTAVYYCVRGRLATAILFDYWGQGTLVTVSSASTKGPSVFPLA
PSSKSTSGGTAALGCLVKDYFPEPVTVSWNSGALTSGVHTFPAV
LQSSGLYSLSSVVTVPSSSLGTQTYICNVNHKPSNTKVDKKVEP
KSCDKTHTCPPCPAPELLGGPSVFLFPPKPKDTLMISRTPEVTC
VVVDVSHEDPEVKFNWYVDGVEVHNAKTKPREEQYNSTYRVVSV
LTVLHQDWLNGKEYKCKVSNKALPAPIEKTISKAKGQPREPQVY
TLPPSREEMTKNQVSLTCLVKGFYPSDIAVEWESNGQPENNYKT
TPPVLDSDGSFFLYSKLTVDKSRWQQGNVFSCSVMHEALHNHYT
QKSLSLSPG |
| 592 | Antibody 6.1 IgG1 HC (VH: S67R_A114S_I134P, VL: F71L)_huIgG1z mAb | QVQLVESGGGVVQPGRSLRLSCEASGFTFSSYVMHWVRQAPGKG
LEWVSVISYDGSRQYYTDSVKGRFTISRDNSKNTLNLQMNSLRA
EDTAVYYCVRGRLATSPLFDYWGQGTLVTVSSASTKGPSVFPLA
PSSKSTSGGTAALGCLVKDYFPEPVTVSWNSGALTSGVHTFPAV
LQSSGLYSLSSVVTVPSSSLGTQTYICNVNHKPSNTKVDKKVEP
KSCDKTHTCPPCPAPELLGGPSVFLFPPKPKDTLMISRTPEVTC
VVVDVSHEDPEVKFNWYVDGVEVHNAKTKPREEQYNSTYRVVSV
LTVLHQDWLNGKEYKCKVSNKALPAPIEKTISKAKGQPREPQVY
TLPPSREEMTKNQVSLTCLVKGFYPSDIAVEWESNGQPENNYKT
TPPVLDSDGSFFLYSKLTVDKSRWQQGNVFSCSVMHEALHNHYT
QKSLSLSPG |
| 593 | Antibody 6.2 IgG1 HC (VH: S67R_Q68A_L135K_F136L, VL: S109T_I110L)_huIgG1z mAb | QVQLVESGGGVVQPGRSLRLSCEASGFTFSSYVMHWVRQAPGKG
LEWVSVISYDGSRAYYTDSVKGRFTISRDNSKNTLNLQMNSLRA
EDTAVYYCVRGRLATAIKLDYWGQGTLVTVSSASTKGPSVFPLA
PSSKSTSGGTAALGCLVKDYFPEPVTVSWNSGALTSGVHTFPAV
LQSSGLYSLSSVVTVPSSSLGTQTYICNVNHKPSNTKVDKKVEP
KSCDKTHTCPPCPAPELLGGPSVFLFPPKPKDTLMISRTPEVTC
VVVDVSHEDPEVKFNWYVDGVEVHNAKTKPREEQYNSTYRVVSV
LTVLHQDWLNGKEYKCKVSNKALPAPIEKTISKAKGQPREPQVY
TLPPSREEMTKNQVSLTCLVKGFYPSDIAVEWESNGQPENNYKT
TPPVLDSDGSFFLYSKLTVDKSRWQQGNVFSCSVMHEALHNHYT
QKSLSLSPG |

TABLE 18

Exemplary nucleic acid sequences that encode antibodies of the present invention.

| SEQ ID NO: | Designation | Sequence |
|---|---|---|
| 594 | Antibody 1 IgG1 HC DNA | GAGGTGCAGCTGGTGGAGTCTGGGGGAGGCTTGGTAAAGCCTGG
GGGGTCCCTGAGACTCTCCTGTGCAGCCTCTGGATTTACTTTCA
GTAACGCCCGGATGGGCTGGGTCCGCCAGGCTCCAGGGAAGGGG
CTGGAGTGGGTTGGCCGTATTAAAAGCAAAACTGAAGGTGGGAC
AAGAGACTACGCTGCACCCGTGAAAGGCAGATTCACCATCTCAA
GAGATGATTCAAAAAACACGCTGTATCTGCAAATGAACAGCCTG
AAAACCGAGGACACAGCCGTGTATTATTGTACCTCGTATAGTGG
GGTCTGGGGCCAAGGGACAATGGTCACCGTCTCTTCAGCCTCCA
CCAAGGGCCCATCGGTCTTCCCCCTGGCACCCTCCTCAAGAGC
ACCTCTGGGGGCACAGCGGCCCTGGGCTGCCTGGTCAAGGACTA
CTTCCCCGAACCGGTGACGGTGTCGTGGAACTCAGGCGCCCTGA
CCAGCGGCGTGCACACCTTCCCGGCTGTCCTACAGTCCTCAGGA
CTCTACTCCCTCAGCAGCGTGGTGACCGTGCCCTCCAGCAGCTT
GGGCACCCAGACCTACATCTGCAACGTGAATCACAAGCCCAGCA
ACACCAAGGTGGACAAGAAAGTTGAGCCCAAATCTTGTGACAAA
ACTCACACATGCCCACCGTGCCCAGCACCTGAACTCCTGGGGGG
ACCGTCAGTCTTCCTCTTCCCCCCAAAACCCAAGGACACCCTCA
TGATCTCCCGGACCCCTGAGGTCACATGCGTGGTGGTGGACGTG
AGCCACGAAGACCCTGAGGTCAAGTTCAACTGGTACGTGGACGG
CGTGGAGGTGCATAATGCCAAGACAAAGCCGCGGGAGGAGCAGT
ACAACAGCACGTACCGTGTGGTCAGCGTCCTCACCGTCCTGCAC
CAGGACTGGCTGAATGGCAAGGAGTACAAGTGCAAGGTGTCCAA
CAAAGCCCTCCCAGCCCCCATCGAGAAAACCATCTCCAAAGCCA
AAGGGCAGCCCCGAGAACCACAGGTGTACACCCTGCCCCCATCC
CGGGAGGAGATGACCAAGAACCAGGTCAGCCTGACCTGCCTGGT
CAAAGGCTTCTATCCCAGCGACATCGCCGTGGAGTGGGAGAGCA
ATGGGCAGCCGGAGAACAACTACAAGACCACGCCTCCCGTGCTG
GACTCCGACGGCTCCTTCTTCCTCTATAGCAAGCTCACCGTGGA
CAAGAGCAGGTGGCAGCAGGGGAACGTCTTCTCATGCTCCGTGA
TGCATGAGGCTCTGCACAACCACTACACGCAGAAGAGCCTCTCC
CTGTCTCCGGGCAAATAG |

TABLE 18-continued

Exemplary nucleic acid sequences that encode antibodies of the present invention.

| SEQ ID NO: | Designation | Sequence |
|---|---|---|
| 595 | Antibody 1 IgG1 LC DNA | GACATCGTGATGACCCAGTCTCCAGACTCCCTGGCTGTGTCTCT<br>GGGCGAGAGGGCCACCATCAACTGCAAGTCCAGCCAGAGTGTTT<br>TATACAGTTCCAACAATAAGAACTACTTAGCTTGGTACCATCAG<br>AAACCAGGACAGTCTCCTAAGCTGCTCATTTCCTGGGCATCTAC<br>CCGGGAATCCGGGGTCCCTGACCGATTCAGTGGCAGCGGGTCTG<br>GGACAGATTTCACTCTCACCATCAACAGCCTGCAGGCTGAAGAT<br>GTGGCAGTTTATTACTGTCAACAATATTATAGTATTCCGATCAC<br>TTTCGGCGGAGGGACCAAGGTGGAGATCAAACGAACGGTGGCTG<br>CACCATCTGTCTTCATCTTCCCGCCATCTGATGAGCAGTTGAAA<br>TCTGGAACTGCCTCTGTTGTGTGCCTGCTGAATAACTTCTATCC<br>CAGAGAGGCCAAAGTACAGTGGAAGGTGGATAACGCCCTCCAAT<br>CGGGTAACTCCCAGGAGAGTGTCACAGAGCAGGACAGCAAGGAC<br>AGCACCTACAGCCTCAGCAGCACCCTGACGCTGAGCAAAGCAGA<br>CTACGAGAAACACAAAGTCTACGCCTGCGAAGTCACCCATCAGG<br>GCCTGAGCTCGCCCGTCACAAAGAGCTTCAACAGGGGAGAGTGT<br>TAG |
| 596 | Antibody 1.1 IgG1 (LC: H45Q_S51P) HC DNA | GAGGTGCAGCTGGTGGAGTCTGGGGGAGGCTTGGTAAAGCCTGG<br>GGGGTCCCTGAGACTCTCCTGTGCAGCCTCTGGATTTACTTTCA<br>GTAACGCCCGGATGGGCTGGGTCCGCCAGGCTCCAGGGAAGGGG<br>CTGGAGTGGGTTGGCCGTATTAAAAGCAAAACTGAAGGTGGGAC<br>AAGAGACTACGCTGCACCCGTGAAAGGCAGATTCACCATCTCAA<br>GAGATGATTCAAAAAACACGCTGTATCTGCAAATGAACAGCCTG<br>AAAACCGAGGACACAGCCGTGTATTATTGTACCTCGTATAGTGG<br>GGTCTGGGGCCAAGGGACAATGGTCACCGTCTCTTCAGCCTCCA<br>CCAAGGGCCCATCGGTCTTCCCCCTGGCACCCTCCTCCAAGAGC<br>ACCTCTGGGGGCACAGCGGCCCTGGGCTGCCTGGTCAAGGACTA<br>CTTCCCCGAACCGGTGACGGTGTCGTGGAACTCAGGCGCCCTGA<br>CCAGCGGCGTGCACACCTTCCCGGCTGTCCTACAGTCCTCAGGA<br>CTCTACTCCCTCAGCAGCGTGGTGACCGTGCCCTCCAGCAGCTT<br>GGGCACCCAGACCTACATCTGCAACGTGAATCACAAGCCCAGCA<br>ACACCAAGGTGGACAAGAAAGTTGAGCCCAAATCTTGTGACAAA<br>ACTCACACATGCCCACCGTGCCCAGCACCTGAACTCCTGGGGGG<br>ACCGTCAGTCTTCCTCTTCCCCCCAAAACCCAAGGACACCCTCA<br>TGATCTCCCGGACCCCTGAGGTCACATGCGTGGTGGTGGACGTG<br>AGCCACGAAGACCCTGAGGTCAAGTTCAACTGGTACGTGGACGG<br>CGTGGAGGTGCATAATGCCAAGACAAAGCCGCGGGAGGAGCAGT<br>ACAACAGCACGTACCGTGTGGTCAGCGTCCTCACCGTCCTGCAC<br>CAGGACTGGCTGAATGGCAAGGAGTACAAGTGCAAGGTGTCCAA<br>CAAAGCCCTCCCAGCCCCCATCGAGAAAACCATCTCCAAAGCCA<br>AAGGGCAGCCCCGAGAACCACAGGTGTACACCCTGCCCCCATCC<br>CGGGAGGAGATGACCAAGAACCAGGTCAGCCTGACCTGCCTGGT<br>CAAAGGCTTCTATCCCAGCGACATCGCCGTGGAGTGGGAGAGCA<br>ATGGGCAGCCGGAGAACAACTACAAGACCACGCCTCCCGTGCTG<br>GACTCCGACGGCTCCTTCTTCCTCTATAGCAAGCTCACCGTGGA<br>CAAGAGCAGGTGGCAGCAGGGGAACGTCTTCTCATGCTCCGTGA<br>TGCATGAGGCTCTGCACAACCACTACACGCAGAAGAGCCTCTCC<br>CTGTCTCCGGGCAAATAG |
| 597 | Antibody 1.1 IgG1 (LC: H45Q_S51P) LC DNA | GACATCGTGATGACCCAGTCTCCAGACTCCCTGGCTGTGTCTCT<br>GGGCGAGAGGGCCACCATCAACTGCAAGTCCAGCCAGAGTGTTT<br>TATACAGTTCCAACAATAAGAACTACTTAGCTTGGTACCAGCAG<br>AAACCAGGACAGCCCCCTAAGCTGCTCATTTCCTGGGCATCTAC<br>CCGGGAATCCGGGGTCCCTGACCGATTCAGTGGCAGCGGGTCTG<br>GGACAGATTTCACTCTCACCATCAACAGCCTGCAGGCTGAAGAT<br>GTGGCAGTTTATTACTGTCAACAATATTATAGTATTCCGATCAC<br>TTTCGGCGGAGGGACCAAGGTGGAGATCAAACGAACGGTGGCTG<br>CACCATCTGTCTTCATCTTCCCGCCATCTGATGAGCAGTTGAAA<br>TCTGGAACTGCCTCTGTTGTGTGCCTGCTGAATAACTTCTATCC<br>CAGAGAGGCCAAAGTACAGTGGAAGGTGGATAACGCCCTCCAAT<br>CGGGTAACTCCCAGGAGAGTGTCACAGAGCAGGACAGCAAGGAC<br>AGCACCTACAGCCTCAGCAGCACCCTGACGCTGAGCAAAGCAGA<br>CTACGAGAAACACAAAGTCTACGCCTGCGAAGTCACCCATCAGG<br>GCCTGAGCTCGCCCGTCACAAAGAGCTTCAACAGGGGAGAGTGT<br>TAG |
| 598 | Antibody 2.1 IgG1 HC (LC: F2I_P51S_H53Q_L103V_N148K, HC: K87N_S94N_V98A)(LC: Y25A_S26A, HC: A71I_D72R) DNA | CAGGTGCAGTTGGTGGAGTCTGGGGGAGGCGTGGTCCAGCCTGG<br>GAGGTCCCTGAGACTCTCCTGTGCAGCCTCTGGATTCACCTTCA<br>GTAACTATGGCATGCACTGGGTCCGCCAGGCTCCAGGCAAGGGG<br>CTGGAGTGGGTGGCAGTCATATCATATGATGGAAGTAATAAATT<br>CTATATCAGATCCGTGAAGGGCCGATTCACCATCTCCAGAGACA<br>ATTCCAAGAACACTCTGTATCTTCAAATGAACAGCCTGAGAGCC<br>GAGGACACGGCTGTATATTATTGTGCGAGAGCCGGGGTATAGG<br>GCGTTTTGACTACTGGGGCCAGGGAACCCTGGTCACCGTCTCCT<br>CAGCCTCCACCAAGGGCCCATCGGTCTTCCCCCTGGCACCCTCC<br>TCCAAGAGCACCTCTGGGGGCACAGCGGCCCTGGGCTGCCTGGT |

TABLE 18-continued

Exemplary nucleic acid sequences that encode antibodies of the present invention.

| SEQ ID NO: | Designation | Sequence |
|---|---|---|
| | | CAAGGACTACTTCCCCGAACCGGTGACGGTGTCGTGGAACTCAG
GCGCCCTGACCAGCGGCGTGCACACCTTCCCGGCTGTCCTACAG
TCCTCAGGACTCTACTCCCTCAGCAGCGTGGTGACCGTGCCCTC
CAGCAGCTTGGGCACCCAGACCTACATCTGCAACGTGAATCACA
AGCCCAGCAACACCAAGGTGGACAAGAAAGTTGAGCCCAAATCT
TGTGACAAAACTCACACATGCCCACCGTGCCCAGCACCTGAACT
CCTGGGGGGACCGTCAGTCTTCCTCTTCCCCCCAAAACCCAAGG
ACACCCTCATGATCTCCCGGACCCCTGAGGTCACATGCGTGGTG
GTGGACGTGAGCCACGAAGACCCTGAGGTCAAGTTCAACTGGTA
CGTGGACGGCGTGGAGGTGCATAATGCCAAGACAAAGCCGCGGG
AGGAGCAGTACAACAGCACGTACCGTGTGGTCAGCGTCCTCACC
GTCCTGCACCAGGACTGGCTGAATGGCAAGGAGTACAAGTGCAA
GGTGTCCAACAAAGCCCTCCCAGCCCCCATCGAGAAAACCATCT
CCAAAGCCAAAGGGCAGCCCCGAGAACCACAGGTGTACACCCTG
CCCCCATCCCGGGAGGAGATGACCAAGAACCAGGTCAGCCTGAC
CTGCCTGGTCAAAGGCTTCTATCCCAGCGACATCGCCGTGGAGT
GGGAGAGCAATGGGCAGCCGGAGAACAACTACAAGACCACGCCT
CCCGTGCTGGACTCCGACGGCTCCTTCTTCCTCTATAGCAAGCT
CACCGTGGACAAGAGCAGGTGGCAGCAGGGGAACGTCTTCTCAT
GCTCCGTGATGCATGAGGCTCTGCACAACCACTACACGCAGAAG
AGCCTCTCCCTGTCTCCGGGCAAATAG |
| 599 | Antibody 2.1 IgG1 LC
(LC: F2I_P51S_H53Q_L103V_N148K,
HC: K87N_S94N_V98A)(LC: Y25A_
S26A, HC: A71I_D72R) DNA | GATATCGTAATGACCCAGACTCCACTCTCTCTGTCCGTCACCCC
TGGACAGCCGGCCTCCATCTCCTGCAAGGCCGCCCAGAGCCTCC
TGCACAGTGATGGAAAGACCTATTTGTTTTGGTACCTGCAGAAG
CCAGGCCAGAGCCCACAGCTCCTGATCTATGAAGTTTCCAACCG
GTTCTCTGGAGTGCCAGATAGGTTCAGTGGCAGCGGGTCAGGGA
CAGATTTCACACTGAAGATCAGCCGGGTGGAGGCTGAGGATGTT
GGGGTGTATTACTGCATGCAAACTTTAAAGCTTCCGCTCACTTT
CGGCGGAGGGACCAAGGTGGAGATCAAGCGAACGGTGGCTGCAC
CATCTGTCTTCATCTTCCCGCCATCTGATGAGCAGTTGAAATCT
GGAACTGCCTCTGTTGTGTGCCTGCTGAATAACTTCTATCCCAG
AGAGGCCAAAGTACAGTGGAAGGTGGATAACGCCCTCCAATCGG
GTAACTCCCAGGAGAGTGTCACAGAGCAGGACAGCAAGGACAGC
ACCTACAGCCTCAGCAGCACCCTGACGCTGAGCAAAGCAGACTA
CGAGAAACACAAAGTCTACGCCTGCGAAGTCACCCATCAGGGCC
TGAGCTCGCCCGTCACAAAGAGCTTCAACAGGGGAGAGTGTTAG |
| 600 | Antibody 2.2 IgG1 HC
(LC: F2I_P51S_H53Q_L103V_N148K,
HC: K87N_S94N_V98A)(LC: Y25A,
HC: A71L_D72K) DNA | CAGGTGCAGTTGGTGGAGTCTGGGGGAGGCGTGGTCCAGCCTGG
GAGGTCCCTGAGACTCTCCTGTGCAGCCTCTGGATTCACCTTCA
GTAACTATGGCATGCACTGGGTCCGCCAGGCTCCAGGCAAGGGG
CTGGAGTGGGTGGCAGTCATATGATGGAAGTAATAAATT
CTATCTGAAGTCCGTGAAGGGCCGATTCACCATCTCCAGAGACA
ATTCCAAGAACACTCTGTATCTTCAAATGAACAGCCTGAGAGCC
GAGGACACGGCTGTATATTATTGTGCGAGAGCCGGGGGTATAGG
GCGTTTTGACTACTGGGGCCAGGGAACCCTGGTCACCGTCTCCT
CAGCCTCCACCAAGGGCCCATCGGTCTTCCCCCTGGCACCCTCC
TCCAAGAGCACCTCTGGGGGCACAGCGGCCCTGGGCTGCCTGGT
CAAGGACTACTTCCCCGAACCGGTGACGGTGTCGTGGAACTCAG
GCGCCCTGACCAGCGGCGTGCACACCTTCCCGGCTGTCCTACAG
TCCTCAGGACTCTACTCCCTCAGCAGCGTGGTGACCGTGCCCTC
CAGCAGCTTGGGCACCCAGACCTACATCTGCAACGTGAATCACA
AGCCCAGCAACACCAAGGTGGACAAGAAAGTTGAGCCCAAATCT
TGTGACAAAACTCACACATGCCCACCGTGCCCAGCACCTGAACT
CCTGGGGGGACCGTCAGTCTTCCTCTTCCCCCCAAAACCCAAGG
ACACCCTCATGATCTCCCGGACCCCTGAGGTCACATGCGTGGTG
GTGGACGTGAGCCACGAAGACCCTGAGGTCAAGTTCAACTGGTA
CGTGGACGGCGTGGAGGTGCATAATGCCAAGACAAAGCCGCGGG
AGGAGCAGTACAACAGCACGTACCGTGTGGTCAGCGTCCTCACC
GTCCTGCACCAGGACTGGCTGAATGGCAAGGAGTACAAGTGCAA
GGTGTCCAACAAAGCCCTCCCAGCCCCCATCGAGAAAACCATCT
CCAAAGCCAAAGGGCAGCCCCGAGAACCACAGGTGTACACCCTG
CCCCCATCCCGGGAGGAGATGACCAAGAACCAGGTCAGCCTGAC
CTGCCTGGTCAAAGGCTTCTATCCCAGCGACATCGCCGTGGAGT
GGGAGAGCAATGGGCAGCCGGAGAACAACTACAAGACCACGCCT
CCCGTGCTGGACTCCGACGGCTCCTTCTTCCTCTATAGCAAGCT
CACCGTGGACAAGAGCAGGTGGCAGCAGGGGAACGTCTTCTCAT
GCTCCGTGATGCATGAGGCTCTGCACAACCACTACACGCAGAAG
AGCCTCTCCCTGTCTCCGGGCAAATAG |
| 601 | Antibody 2.2 IgG1 LC
(LC: F2I_P51S_H53Q_L103V_N148K,
HC: K87N_S94N_V98A)(LC: Y25A,
HC: A71L_D72K) DNA | GATATCGTAATGACCCAGACTCCACTCTCTCTGTCCGTCACCCC
TGGACAGCCGGCCTCCATCTCCTGCAAGGCCAGTCAGAGCCTCC
TGCACAGTGATGAAAGACCTATTTGTTTTGGTACCTGCAGAAG
CCAGGCCAGAGCCCACAGCTCCTGATCTATGAAGTTTCCAACCG
GTTCTCTGGAGTGCCAGATAGGTTCAGTGGCAGCGGGTCAGGGA
CAGATTTCACACTGAAGATCAGCCGGGTGGAGGCTGAGGATGTT |

TABLE 18-continued

Exemplary nucleic acid sequences that encode antibodies of the present invention.

| SEQ ID NO: | Designation | Sequence |
|---|---|---|
| | | GGGGTGTATTACTGCATGCAAACTTTAAAGCTTCCGCTCACTTT
CGGCGGAGGGACCAAGGTGGAGATCAAGCGAACGGTGGCTGCAC
CATCTGTCTTCATCTTCCCGCCATCTGATGAGCAGTTGAAATCT
GGAACTGCCTCTGTTGTGTGCCTGCTGAATAACTTCTATCCCAG
AGAGGCCAAAGTACAGTGGAAGGTGGATAACGCCCTCCAATCGG
GTAACTCCCAGGAGAGTGTCACAGAGCAGGACAGCAAGGACAGC
ACCTACAGCCTCAGCAGCACCCTGACGCTGAGCAAAGCAGACTA
CGAGAAACACAAAGTCTACGCCTGCGAAGTCACCCATCAGGGCC
TGAGCTCGCCCGTCACAAAGAGCTTCAACAGGGGAGAGTGTTAG |
| 602 | Antibody 3.0 IgG1 HC DNA | GAGGTGCAGCTGGTGGAGTCTGGGGGAGGCTTGGTAAAGCCTGG
GGGGTCCCTTAGACTCTCCTGTGCAGCCTCTGGATTCATTTTTA
GTAATGCCTGGATGAGCTGGGTCCGCCAGGCTCCAGGGAAGGGG
CTGGAGTGGGTTGCCCGTATTAAAAGGAGAACTGATGGTGGGAC
AACTGACTACGCTGCACCCGTGAAAGACAGATTCACCATCTCAA
GAGATGATTCAAAAAACACGCTGTTTCTGCAAATGAACAGCCTG
AAAACCGAGGACACAGCCGTGTATTACTGTACCACAGTTACTAT
GGTTCGGGGAGTTATTGCTGATTACTGGGGCCAGGGAACCCTGG
TCACCGTCTCCTCAGCCTCCACCAAGGGCCCATCGGTCTTCCCC
CTGGCACCCTCCTCCAAGAGCACCTCTGGGGGCACAGCGGCCCT
GGGCTGCCTGGTCAAGGACTACTTCCCCGAACCGGTGACGGTGT
CGTGGAACTCAGGCGCCCTGACCAGCGGCGTGCACACCTTCCCG
GCTGTCCTACAGTCCTCAGGACTCTACTCCCTCAGCAGCGTGGT
GACCGTGCCCTCCAGCAGCTTGGGCACCCAGACCTACATCTGCA
ACGTGAATCACAAGCCCAGCAACACCAAGGTGGACAAGAAAGTT
GAGCCCAAATCTTGTGACAAAACTCACACATGCCCACCGTGCCC
AGCACCTGAACTCCTGGGGGGACCGTCAGTCTTCCTCTTCCCCC
CAAAACCCAAGGACACCCTCATGATCTCCCGGACCCCTGAGGTC
ACATGCGTGGTGGTGGACGTGAGCCACGAAGACCCTGAGGTCAA
GTTCAACTGGTACGTGGACGGCGTGGAGGTGCATAATGCCAAGA
CAAAGCCGCGGGAGGAGCAGTACAACAGCACGTACCGTGTGGTC
AGCGTCCTCACCGTCCTGCACCAGGACTGGCTGAATGGCAAGGA
GTACAAGTGCAAGGTGTCCAACAAAGCCCTCCCAGCCCCCATCG
AGAAAACCATCTCCAAAGCCAAAGGGCAGCCCCGAGAACCACAG
GTGTACACCCTGCCCCCATCCCGGGAGGAGATGACCAAGAACCA
GGTCAGCCTGACCTGCCTGGTCAAAGGCTTCTATCCCAGCGACA
TCGCCGTGGAGTGGGAGAGCAATGGGCAGCCGGAGAACAACTAC
AAGACCACGCCTCCCGTGCTGGACTCCGACGGCTCCTTCTTCCT
CTATAGCAAGCTCACCGTGGACAAGAGCAGGTGGCAGCAGGGGA
ACGTCTTCTCATGCTCCGTGATGCATGAGGCTCTGCACAACCAC
TACACGCAGAAGAGCCTCTCCCTGTCTCCGGGCAAATAG |
| 603 | Antibody 3.0 IgG1 LC DNA | GAAATTGTGTTGACGCAGTCTCCAGGCACCCTGTCTTTGTCTCC
AGGGGAAAGAGCCACCCTCTCCTGCAGGGCCAGTCAGAGTGTTA
GCAGCGGCTCCTTAGCCTGGTACCAGCAGAAACTTGGCCAGGCT
CCCAGGCTCCTCATCTATGGTGCATCCAGCAGGGCCACTGGCAT
CCCAGACAGGTTCAGTGGCAGTGGGTCTGGGACAGACTTCACTC
TCACCATCAGCAGCCTGGAGCCTGAAGATTTTGCAGTGTATTAC
TGTCAACAGTATGGTAGCTCACGGACGTTCGGCCAAGGGACCAA
GGTGGAGCTCAAACGAACGGTGGCTGCACCATCTGTCTTCATCT
TCCCGCCATCTGATGAGCAGTTGAAATCTGGAACTGCCTCTGTT
GTGTGCCTGCTGAATAACTTCTATCCCAGAGAGGCCAAAGTACA
GTGGAAGGTGGATAACGCCCTCCAATCGGGTAACTCCCAGGAGA
GTGTCACAGAGCAGGACAGCAAGGACAGCACCTACAGCCTCAGC
AGCACCCTGACGCTGAGCAAAGCAGACTACGAGAAACACAAAGT
CTACGCCTGCGAAGTCACCCATCAGGGCCTGAGCTCGCCCGTCA
CAAAGAGCTTCAACAGGGGAGAGTGTTAG |
| 604 | Antibody 4.0 IgG1 HC DNA | GAGGTGCAGCTGGTGGAGTCTGGGGGAGGCTTGGTAAAGCCTGG
GGGGTCCCTTAGACTCTCCTGTGCAGCCTCTGGATTCATTTTCA
GTAACGCCTGGATGAGCTGGGTCCGCCAGGCTCCAGGGAAGGGG
CTGGAGTGGGTTGGCCGTATAAAAAGGAAAACTGATGGTGGTAC
AACAGACTACGCTGCACCCGTGAAAGGCAGATTCACCATCTCAA
GAGATGATTCAAAAAACACGTTGTATCTGCTAATGAACAGCCTG
AAAATCGAGGACACAGCCGTGTATTATTGTACCGTCGTAACTTT
GGTTCGGGGAATTATCTTTGACTACTGGGGCCAGGGAACCCTGG
TCACCGTCTCCTCAGCCTCCACCAAGGGCCCATCGGTCTTCCCC
CTGGCACCCTCCTCCAAGAGCACCTCTGGGGGCACAGCGGCCCT
GGGCTGCCTGGTCAAGGACTACTTCCCCGAACCGGTGACGGTGT
CGTGGAACTCAGGCGCCCTGACCAGCGGCGTGCACACCTTCCCG
GCTGTCCTACAGTCCTCAGGACTCTACTCCCTCAGCAGCGTGGT
GACCGTGCCCTCCAGCAGCTTGGGCACCCAGACCTACATCTGCA
ACGTGAATCACAAGCCCAGCAACACCAAGGTGGACAAGAAAGTT
GAGCCCAAATCTTGTGACAAAACTCACACATGCCCACCGTGCCC
AGCACCTGAACTCCTGGGGGGACCGTCAGTCTTCCTCTTCCCCC
CAAAACCCAAGGACACCCTCATGATCTCCCGGACCCCTGAGGTC |

TABLE 18-continued

Exemplary nucleic acid sequences that encode antibodies of the present invention.

| SEQ ID NO: | Designation | Sequence |
|---|---|---|
| | | ACATGCGTGGTGGTGGACGTGAGCCACGAAGACCCTGAGGTCAA<br>GTTCAACTGGTACGTGGACGGCGTGGAGGTGCATAATGCCAAGA<br>CAAAGCCGCGGGAGGAGCAGTACAACAGCACGTACCGTGTGGTC<br>AGCGTCCTCACCGTCCTGCACCAGGACTGGCTGAATGGCAAGGA<br>GTACAAGTGCAAGGTGTCCAACAAAGCCCTCCCAGCCCCCATCG<br>AGAAAACCATCTCCAAAGCCAAAGGGCAGCCCCGAGAACCACAG<br>GTGTACACCCTGCCCCCATCCCGGGAGGAGATGACCAAGAACCA<br>GGTCAGCCTGACCTGCCTGGTCAAAGGCTTCTATCCCAGCGACA<br>TCGCCGTGGAGTGGGAGAGCAATGGGCAGCCGGAGAACAACTAC<br>AAGACCACGCCTCCCGTGCTGGACTCCGACGGCTCCTTCTTCCT<br>CTATAGCAAGCTCACCGTGGACAAGAGCAGGTGGCAGCAGGGGA<br>ACGTCTTCTCATGCTCCGTGATGCATGAGGCTCTGCACAACCAC<br>TACACGCAGAAGAGCCTCTCCCTGTCTCCGGGCAAATAG |
| 605 | Antibody 4.0 IgG1 LC DNA | GAAATTGTGTTGACGCAGTCTCCGGGCACCCTGTCTTTGTCTCC<br>AGGGGAAAGCGCCACCCTCTCCTGTAGGGTCAGTCAGAGTGTCA<br>GCAGCAGCCAGTTAGCCTGGTACCAGCAGAAACCTGGCCAGGCT<br>CCCAGGCTCCTCATCTATGGTGCATCCAGCAGGGCCACTGGCAT<br>CCCAGACAGGTTCAGTGGCAGTGGGTCTGGGACAGACTTCACTC<br>TCACCATCAGCAGACTGGAGCCTGAAGATTTTGCAGTGTATTAC<br>TGTCAGCAGTATGGTAACTCACGGACGTTCGGCCAAGGGACCAA<br>GGTGGAAATCAAACGAACGGTGGCTGCACCATCTGTCTTCATCT<br>TCCCGCCATCTGATGAGCAGTTGAAATCTGGAACTGCCTCTGTT<br>GTGTGCCTGCTGAATAACTTCTATCCCAGAGAGGCCAAAGTACA<br>GTGGAAGGTGGATAACGCCCTCCAATCGGGTAACTCCCAGGAGA<br>GTGTCACAGAGCAGGACAGCAAGGACAGCACCTACAGCCTCAGC<br>AGCACCCTGACGCTGAGCAAAGCAGACTACGAGAAACACAAAGT<br>CTACGCCTGCGAAGTCACCCATCAGGGCCTGAGCTCGCCCGTCA<br>CAAAGAGCTTCAACAGGGGAGAGTGTTAG |
| 606 | Antibody 4.1 IgG1 HC<br>(VH: M41L_S42Q_L111R_V112S, VL:<br>S18R_S136P)_huIgG1z<br>mAb(LC: R18S, HC: G65Q_G66L)<br>DNA | GAGGTGCAGCTGGTGGAGTCTGGGGGAGGCTTGGTAAAGCCTGG<br>GGGGTCCCTTAGACTCTCCTGTGCAGCCTCTGGATTCATTTTCA<br>GTAACGCCTGGCTGCAGTGGGTCCGCCAGGCTCCAGGGAAGGGG<br>CTGGAGTGGGTTGGCCGTATCAAAAGGAAAACTGATCAGCTGAC<br>AACAGACTACGCTGCACCCGTGAAAGGCAGATTCACCATCTCAA<br>GAGATGATTCAAAAAACACGTTGTATCTGCTAATGAACAGCCTG<br>AAAATCGAGGACACAGCCGTGTATTATTGTACCGTCGTAACTAG<br>AAGCCGGGGAATTATCTTTGACTACTGGGGCCAGGGAACCCTGG<br>TCACCGTGTCCTCAGCCTCCACCAAGGGCCCATCGGTCTTCCCC<br>CTGGCACCCTCCTCCAAGAGCACCTCTGGGGGCACAGCGGCCCT<br>GGGCTGCCTGGTCAAGGACTACTTCCCCGAACCGGTGACGGTGT<br>CGTGGAACTCAGGCGCCCTGACCAGCGGCGTGCACACCTTCCCG<br>GCTGTCCTACAGTCCTCAGGACTCTACTCCCTCAGCAGCGTGGT<br>GACCGTGCCCTCCAGCAGCTTGGGCACCCAGACCTACATCTGCA<br>ACGTGAATCACAAGCCCAGCAACACCAAGGTGGACAAGAAAGTT<br>GAGCCCAAATCTTGTGACAAAACTCACACATGCCCACCGTGCCC<br>AGCACCTGAACTCCTGGGGGGACCGTCAGTCTTCCTCTTCCCCC<br>CAAAACCCAAGGACACCCTCATGATCTCCCGGACCCCTGAGGTC<br>ACATGCGTGGTGGTGGACGTGAGCCACGAAGACCCTGAGGTCAA<br>GTTCAACTGGTACGTGGACGGCGTGGAGGTGCATAATGCCAAGA<br>CAAAGCCGCGGGAGGAGCAGTACAACAGCACGTACCGTGTGGTC<br>AGCGTCCTCACCGTCCTGCACCAGGACTGGCTGAATGGCAAGGA<br>GTACAAGTGCAAGGTGTCCAACAAAGCCCTCCCAGCCCCCATCG<br>AGAAAACCATCTCCAAAGCCAAAGGGCAGCCCCGAGAACCACAG<br>GTGTACACCCTGCCCCCATCCCGGGAGGAGATGACCAAGAACCA<br>GGTCAGCCTGACCTGCCTGGTCAAAGGCTTCTATCCCAGCGACA<br>TCGCCGTGGAGTGGGAGAGCAATGGGCAGCCGGAGAACAACTAC<br>AAGACCACGCCTCCCGTGCTGGACTCCGACGGCTCCTTCTTCCT<br>CTATAGCAAGCTCACCGTGGACAAGAGCAGGTGGCAGCAGGGGA<br>ACGTCTTCTCATGCTCCGTGATGCATGAGGCTCTGCACAACCAC<br>TACACGCAGAAGAGCCTCTCCCTGTCTCCGGGCAAATAG |
| 607 | Antibody 4.1 IgG1 LC<br>(VH: M41L_S42Q_L111R_V112S, VL:<br>S18R_S136P)_huIgG1z<br>mAb(LC: R18S, HC: G65Q_G66L)<br>DNA | GAAATTGTGTTGACGCAGTCTCCGGGCACCCTGTCTTTGTCTCC<br>AGGGGAAAGCGCCACCCTCTCCTGTAGGGTCAGTCAGAGTGTCA<br>GCAGCAGCCAGTTAGCCTGGTACCAGCAGAAACCTGGCCAGGCT<br>CCCAGGCTCCTCATCTATGGTGCATCCAGCAGGGCCACTGGCAT<br>CCCAGACAGGTTCAGTGGCAGTGGGTCTGGGACAGACTTCACTC<br>TCACCATCAGCAGACTGGAGCCTGAAGATTTTGCAGTGTATTAC<br>TGTCAGCAGTATGGTAACCCCGGACGTTCGGCCAAGGGACCAA<br>GGTGGAAATCAAACGAACGGTGGCTGCACCATCTGTCTTCATCT<br>TCCCGCCATCTGATGAGCAGTTGAAATCTGGAACTGCCTCTGTT<br>GTGTGCCTGCTGAATAACTTCTATCCCAGAGAGGCCAAAGTACA<br>GTGGAAGGTGGATAACGCCCTCCAATCGGGTAACTCCCAGGAGA |

TABLE 18-continued

Exemplary nucleic acid sequences that encode antibodies of the present invention.

| SEQ ID NO: | Designation | Sequence |
|---|---|---|
|  |  | GTGTCACAGAGCAGGACAGCAAGGACAGCACCTACAGCCTCAGC<br>AGCACCCTGACGCTGAGCAAAGCAGACTACGAGAAACACAAAGT<br>CTACGCCTGCGAAGTCACCCATCAGGGCCTGAGCTCGCCCGTCA<br>CAAAGAGCTTCAACAGGGGAGAGTGTTAG |
| 608 | Antibody 4.2 IgG1 HC<br>(VH: M41L_S42Q_L111R_V112S, VL:<br>S18R_S136P)_huIgG1z<br>mAb(LC: R18S, HC: G65A_G66S)<br>DNA | GAGGTGCAGCTGGTGGAGTCTGGGGGAGGCTTGGTAAAGCCTGG<br>GGGGTCCCTTAGACTCTCCTGTGCAGCCTCTGGATTCATTTTCA<br>GTAACGCCTGGCTGCAGTGGGTCCGCCAGGCTCCAGGGAAGGGG<br>CTGGAGTGGGTTGGCCGTATCAAAAGGAAAACTGATGCCAGCAC<br>AACAGACTACGCTGCACCCGTGAAAGGCAGATTCACCATCTCAA<br>GAGATGATTCAAAAAACACGTTGTATCTGCTAATGAACAGCCTG<br>AAAATCGAGGACACAGCCGTGTATTATTGTACCGTCGTAACTAG<br>AAGCCGGGGAATTATCTTTGACTACTGGGGCCAGGGAACCCTGG<br>TCACCGTGTCCTCAGCCTCCACCAAGGGCCCATCGGTCTTCCCC<br>CTGGCACCCTCCTCCAAGAGCACCTCTGGGGGCACAGCGGCCCT<br>GGGCTGCCTGGTCAAGGACTACTTCCCCGAACCGGTGACGGTGT<br>CGTGGAACTCAGGCGCCCTGACCAGCGGCGTGCACACCTTCCCG<br>GCTGTCCTACAGTCCTCAGGACTCTACTCCCTCAGCAGCGTGGT<br>GACCGTGCCCTCCAGCAGCTTGGGCACCCAGACCTACATCTGCA<br>ACGTGAATCACAAGCCCAGCAACACCAAGGTGGACAAGAAAGTT<br>GAGCCCAAATCTTGTGACAAAACTCACACATGCCCACCGTGCCC<br>AGCACCTGAACTCCTGGGGGGACCGTCAGTCTTCCTCTTCCCCC<br>CAAAACCCAAGGACACCCTCATGATCTCCCGGACCCCTGAGGTC<br>ACATGCGTGGTGGTGGACGTGAGCCACGAAGACCCTGAGGTCAA<br>GTTCAACTGGTACGTGGACGGCGTGGAGGTGCATAATGCCAAGA<br>CAAAGCCGCGGGAGGAGCAGTACAACAGCACGTACCGTGTGGTC<br>AGCGTCCTCACCGTCCTGCACCAGGACTGGCTGAATGGCAAGGA<br>GTACAAGTGCAAGGTGTCCAACAAAGCCCTCCCAGCCCCCATCG<br>AGAAAACCATCTCCAAAGCCAAAGGGCAGCCCCGAGAACCACAG<br>GTGTACACCCTGCCCCCATCCCGGGAGGAGATGACCAAGAACCA<br>GGTCAGCCTGACCTGCCTGGTCAAAGGCTTCTATCCCAGCGACA<br>TCGCCGTGGAGTGGGAGAGCAATGGGCAGCCGGAGAACAACTAC<br>AAGACCACGCCTCCCGTGCTGGACTCCGACGGCTCCTTCTTCCT<br>CTATAGCAAGCTCACCGTGGACAAGAGCAGGTGGCAGCAGGGGA<br>ACGTCTTCTCATGCTCCGTGATGCATGAGGCTCTGCACAACCAC<br>TACACGCAGAAGAGCCTCTCCCTGTCTCCGGGCAAATAG |
| 609 | Antibody 4.2 IgG1 LC<br>(VH: M41L_S42Q_L111R_V112S, VL:<br>S18R_S136P)_huIgG1z<br>mAb(LC: R18S, HC: G65A_G66S)<br>DNA | GAAATTGTGTTGACGCAGTCTCCGGGCACCCTGTCTTTGTCTCC<br>AGGGGAAAGCGCCACCCTCTCCTGTAGGGTCAGTCAGAGTGTCA<br>GCAGCAGCCAGTTAGCCTGGTACCAGCAGAAACCTGGCCAGGCT<br>CCCAGGCTCCTCATCTATGGTGCATCCAGCAGGGCCACTGGCAT<br>CCCAGACAGGTTCAGTGGCAGTGGGTCTGGGACAGACTTCACTC<br>TCACCATCAGCAGACTGGAGCCTGAAGATTTTGCAGTGTATTAC<br>TGTCAGCAGTATGGTAACCCCCGGACGTTCGGCCAAGGGACCAA<br>GGTGGAAATCAAACGAACGGTGGCTGCACCATCTGTCTTCATCT<br>TCCCGCCATCTGATGAGCAGTTGAAATCTGGAACTGCCTCTGTT<br>GTGTGCCTGCTGAATAACTTCTATCCCAGAGAGGCCAAAGTACA<br>GTGGAAGGTGGATAACGCCCTCCAATCGGGTAACTCCCAGGAGA<br>GTGTCACAGAGCAGGACAGCAAGGACAGCACCTACAGCCTCAGC<br>AGCACCCTGACGCTGAGCAAAGCAGACTACGAGAAACACAAAGT<br>CTACGCCTGCGAAGTCACCCATCAGGGCCTGAGCTCGCCCGTCA<br>CAAAGAGCTTCAACAGGGGAGAGTGTTAG |
| 610 | Antibody 5.0 IgG1 HC DNA | CAGGTGCAGCTGGTGGAGTCTGGGGGAGGCGTGGTCCAGCCTGG<br>GAGGTCCCTGAGACTCTCCTGTGCAGCCTCTGGATTCACCTTCA<br>GTAGCTATGGCATGCACTGGGTCCGCCAGGCTCCAGGCAAGGGG<br>CTGGAGTGGGTGGCAGTTATATCATATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCT<br>GAGGACACGGCTGTGTATTACTGTGCGAGGGGGCGATATTTTGA<br>CTGGTTCCTCTTTGACTACTGGGGCCAGGGAACCCTGGTCACCG<br>TCTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA |

TABLE 18-continued

Exemplary nucleic acid sequences that encode antibodies of the present invention.

| SEQ ID NO: | Designation | Sequence |
|---|---|---|
| | | CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 611 | Antibody 5.0 IgG1 LC DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGTGATGGAAAGACCTATTTGTTTTGGTACCTGCAGAAG<br>CCAGGCCAGCCTCCACAGCTCCTGATCAGTGAAGTTTCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGTTTTATTACTGCATGCAAAGTTTACGGCTTCCGCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 612 | Antibody 5.1 IgG1 HC<br>(VH: F134T, VL: S34R_S57Y_F103V)<br>huIgG1z mAb DNA | CAGGTGCAGCTGGTGGAGTCTGGGGGAGGCGTGGTCCAGCCTGG<br>GAGGTCCCTGAGACTCTCCTGTGCAGCCTCTGGATTCACCTTCA<br>GTAGCTATGGCATGCACTGGGTCCGCCAGGCTCCAGGCAAGGGG<br>CTGGAGTGGGTGGCAGTTATCTCATATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCT<br>GAGGACACGGCTGTGTATTACTGTGCGAGGGGGCGATATTTTGA<br>CTGGACCCTCTTTGACTACTGGGGCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 613 | Antibody 5.1 IgG1 LC<br>(VH: F134T, VL: S34R_S57Y_F103V)<br>huIgG1z mAb DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGAGATGGAAAGACCTATTTGTTTTGGTACCTGCAGAAG<br>CCAGGCCAGCCTCCACAGCTCCTGATCTACGAAGTTTCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGGTGTATTACTGCATGCAAAGTTTACGGCTTCCGCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |

TABLE 18-continued

Exemplary nucleic acid sequences that encode antibodies of the present invention.

| SEQ ID NO: | Designation | Sequence |
| --- | --- | --- |
| 614 | Antibody 5.2 IgG1 HC (VH: G40PF134T, VL: S57Y_E58L_ V67R_F103V)_huIgG1z mAb DNA | CAGGTGCAGCTGGTGGAGTCTGGGGGAGGCGTGGTCCAGCCTGG GAGGTCCCTGAGACTCTCCTGTGCAGCCTCTGGATTCACCTTCA GTAGCTATCCCATGCACTGGGTCCGCCAGGCTCCAGGCAAGGGG CTGGAGTGGGTGGCAGTTATCTCATATGATGGAAGTAATAAATA CTATGCAGACTCCGTGAAGGGCCGATTCACCATCTCCAGAGACA ATTCCAAGAACACGCTGTATCTGCAAATGAACAGCCTGAGAGCT GAGGACACGGCTGTGTATTACTGTGCGAGGGGGCGATATTTTGA CTGGACCCTCTTTTGACTACTGGGGCCAGGGAACCCTGGTCACCG TGTCCTCAGCCTCCACCAAGGGCCCATCGGTCTTCCCCCTGGCA CCCTCCTCCAAGAGCACCTCTGGGGGCACAGCGGCCCTGGGCTG CCTGGTCAAGGACTACTTCCCCGAACCGGTGACGGTGTCGTGGA ACTCAGGCGCCCTGACCAGCGGCGTGCACACCTTCCCGGCTGTC CTACAGTCCTCAGGACTCTACTCCCTCAGCAGCGTGGTGACCGT GCCCTCCAGCAGCTTGGGCACCCAGACCTACATCTGCAACGTGA ATCACAAGCCCAGCAACACCAAGGTGGACAAGAAAGTTGAGCCC AAATCTTGTGACAAAACTCACACATGCCCACCGTGCCCAGCACC TGAACTCCTGGGGGGACCGTCAGTCTTCCTCTTCCCCCCAAAAC CCAAGGACACCCTCATGATCTCCCGGACCCCTGAGGTCACATGC GTGGTGGTGGACGTGAGCCACGAAGACCCTGAGGTCAAGTTCAA CTGGTACGTGGACGGCGTGGAGGTGCATAATGCCAAGACAAAGC CGCGGGAGGAGCAGTACAACAGCACGTACCGTGTGGTCAGCGTC CTCACCGTCCTGCACCAGGACTGGCTGAATGGCAAGGAGTACAA GTGCAAGGTGTCCAACAAAGCCCTCCCAGCCCCCATCGAGAAAA CCATCTCCAAAGCCAAAGGGCAGCCCCGAGAACCACAGGTGTAC ACCCTGCCCCCATCCCGGGAGGAGATGACCAAGAACCAGGTCAG CCTGACCTGCCTGGTCAAAGGCTTCTATCCCAGCGACATCGCCG TGGAGTGGGAGAGCAATGGGCAGCCGGAGAACAACTACAAGACC ACGCCTCCCGTGCTGGACTCCGACGGCTCCTTCTTCCTCTATAG CAAGCTCACCGTGGACAAGAGCAGGTGGCAGCAGGGGAACGTCT TCTCATGCTCCGTGATGCATGAGGCTCTGCACAACCACTACACG CAGAAGAGCCTCTCCCTGTCTCCGGGCAAATAG |
| 615 | Antibody 5.2 IgG1 LC (VH: G40PF134T, VL: S57Y_E58L_ V67R_F103V)_huIgG1z mAb DNA | GATACTGTGATGACCCAGACTCCACTCTCTCTGTCCGTCACCCC TGGACAGCCGGCCTCCATCTCCTGCAAGTCTAGTCAGAGCCTCC TACATAGTGATGGAAAGACCTATTTGTTTTGGTACCTGCAGAAG CCAGGCCAGCCTCCACAGCTCCTGATCTACCTGAGATCCAACCG GTTCTCTGGAGTGCCAGATAGGTTCAGTGGCAGCGGGTCAGGGA CAGATTTCACACTGAAAATCAGCCGTGTGGAGGCTGAGGATGTT GGGGTGTATTACTGCATGCAAAGTTTACGGCTTCCGCTCACTTT CGGCGGAGGGACCAAGGTGGAGATCAAACGAACGGTGGCTGCAC CATCTGTCTTCATCTTCCCGCCATCTGATGAGCAGTTGAAATCT GGAACTGCCTCTGTTGTGTGCCTGCTGAATAACTTCTATCCCAG AGAGGCCAAAGTACAGTGGAAGGTGGATAACGCCCTCCAATCGG GTAACTCCCAGGAGAGTGTCACAGAGCAGGACAGCAAGGACAGC ACCTACAGCCTCAGCAGCACCCTGACGCTGAGCAAAGCAGACTA CGAGAAACACAAAGTCTACGCCTGCGAAGTCACCCATCAGGGCC TGAGCTCGCCCGTCACAAAGAGCTTCAACAGGGGAGAGTGTTAG |
| 616 | Antibody 5.3 IgG1 HC (VH: A71S_D72R, VL: S57Y_E58L_ V67S_F103V)_huIgG1z mAb DNA | CAGGTGCAGCTGGTGGAGTCTGGGGGAGGCGTGGTCCAGCCTGG GAGGTCCCTGAGACTCTCCTGTGCAGCCTCTGGATTCACCTTCA GTAGCTATGGCATGCACTGGGTCCGCCAGGCTCCAGGCAAGGGG CTGGAGTGGGTGGCAGTTATCTCATATGATGGAAGTAATAAATA CTATAGCAGATCCGTGAAGGGCCGATTCACCATCTCCAGAGACA ATTCCAAGAACACGCTGTATCTGCAAATGAACAGCCTGAGAGCT GAGGACACGGCTGTGTATTACTGTGCGAGGGGGCGATATTTTGA CTGGTTCCTCTTTGACTACTGGGGCCAGGGAACCCTGGTCACCG TGTCCTCAGCCTCCACCAAGGGCCCATCGGTCTTCCCCCTGGCA CCCTCCTCCAAGAGCACCTCTGGGGGCACAGCGGCCCTGGGCTG CCTGGTCAAGGACTACTTCCCCGAACCGGTGACGGTGTCGTGGA ACTCAGGCGCCCTGACCAGCGGCGTGCACACCTTCCCGGCTGTC CTACAGTCCTCAGGACTCTACTCCCTCAGCAGCGTGGTGACCGT GCCCTCCAGCAGCTTGGGCACCCAGACCTACATCTGCAACGTGA ATCACAAGCCCAGCAACACCAAGGTGGACAAGAAAGTTGAGCCC AAATCTTGTGACAAAACTCACACATGCCCACCGTGCCCAGCACC TGAACTCCTGGGGGGACCGTCAGTCTTCCTCTTCCCCCCAAAAC CCAAGGACACCCTCATGATCTCCCGGACCCCTGAGGTCACATGC GTGGTGGTGGACGTGAGCCACGAAGACCCTGAGGTCAAGTTCAA CTGGTACGTGGACGGCGTGGAGGTGCATAATGCCAAGACAAAGC CGCGGGAGGAGCAGTACAACAGCACGTACCGTGTGGTCAGCGTC CTCACCGTCCTGCACCAGGACTGGCTGAATGGCAAGGAGTACAA GTGCAAGGTGTCCAACAAAGCCCTCCCAGCCCCCATCGAGAAAA CCATCTCCAAAGCCAAAGGGCAGCCCCGAGAACCACAGGTGTAC ACCCTGCCCCCATCCCGGGAGGAGATGACCAAGAACCAGGTCAG CCTGACCTGCCTGGTCAAAGGCTTCTATCCCAGCGACATCGCCG TGGAGTGGGAGAGCAATGGGCAGCCGGAGAACAACTACAAGACC |

TABLE 18-continued

Exemplary nucleic acid sequences that encode antibodies of the present invention.

| SEQ ID NO: | Designation | Sequence |
|---|---|---|
| | | ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 617 | Antibody 5.3 IgG1 LC<br>(VH: A71S_D72R, VL: S57Y_E58L_<br>V67S_F103V)_huIgG1z mAb DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGTGATGGAAAGACCTATTTGTTTTGGTACCTGCAGAAG<br>CCAGGCCAGCCTCCACAGCTCCTGATCTACCTGAGCTCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGGTGTATTACTGCATGCAAAGTTTACGGCTTCCGCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 618 | Antibody 5.4 IgG1 HC<br>(VH: G40A, VL: S57Y_E58L_V67T_<br>F103V)_huIgG1z mAb DNA | CAGGTGCAGCTGGTGGAGTCTGGGGGAGGCGTGGTCCAGCCTGG<br>GAGGTCCCTGAGACTCTCCTGTGCAGCCTCTGGATTCACCTTCA<br>GTAGCTATGCCATGCACTGGGTCCGCCAGGCTCCAGGCAAGGGG<br>CTGGAGTGGGTGGCAGTTATCTCATATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCT<br>GAGGACACGGCTGTGTATTACTGTGCGAGGGGGCGATATTTTGA<br>CTGGTTCCTTTTGACTACTGGGGCCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 619 | Antibody 5.4 IgG1 LC<br>(VH: G40A, VL: S57Y_E58L_V67T_<br>F103V)_huIgG1z mAb DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGTGATGGAAAGACCTATTTGTTTTGGTACCTGCAGAAG<br>CCAGGCCAGCCTCCACAGCTCCTGATCTACCTGACCTCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGGTGTATTACTGCATGCAAAGTTTACGGCTTCCGCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 620 | Antibody 5.5 IgG1 HC<br>(VH: G40P_M41V, VL: S57Y_E58L_<br>V67T_F103V)_huIgG1z mAb DNA | CAGGTGCAGCTGGTGGAGTCTGGGGGAGGCGTGGTCCAGCCTGG<br>GAGGTCCCTGAGACTCTCCTGTGCAGCCTCTGGATTCACCTTCA<br>GTAGCTATCCCGTGCACTGGGTCCGCCAGGCTCCAGGCAAGGGG<br>CTGGAGTGGGTGGCAGTTATCTCATATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCT<br>GAGGACACGGCTGTGTATTACTGTGCGAGGGGGCGATATTTTGA |

TABLE 18-continued

Exemplary nucleic acid sequences that encode antibodies of the present invention.

| SEQ ID NO: | Designation | Sequence |
|---|---|---|
| | | CTGGTTCCTCTTTGACTACTGGGGCCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 621 | Antibody 5.5 IgG1 LC<br>(VH: G40P_M41V, VL: S57Y_E58L_<br>V67T_F103V)_huIgG1z mAb DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGTGATGGAAAGACCTATTTGTTTTGGTACCTGCAGAAG<br>CCAGGCCAGCCTCCACAGCTCCTGATCTACCTGACCTCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGGTGTATTACTGCATGCAAAGTTTACGGCTTCCGCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 622 | Antibody 5.6 IgG1 HC<br>(VH: F134T, VL: S34R_S57Y_F103V)_<br>huIgG1z<br>mAb(LC: G37A_K38R_M107L) DNA | CAGGTGCAGCTGGTGGAGTCTGGGGGAGGCGTGGTCCAGCCTGG<br>GAGGTCCCTGAGACTCTCCTGTGCAGCCTCTGGATTCACCTTCA<br>GTAGCTATGGCATGCACTGGGTCCGCCAGGCTCCAGGCAAGGGG<br>CTGGAGTGGGTGGCAGTTATCTCATATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCT<br>GAGGACACGGCTGTGTATTACTGTGCGAGGGGGCGATATTTTGA<br>CTGGACCCTCTTTGACTACTGGGGCCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |

TABLE 18-continued

Exemplary nucleic acid sequences that encode antibodies of the present invention.

| SEQ ID NO: | Designation | Sequence |
|---|---|---|
| 623 | Antibody 5.6 IgG1 LC (VH: F134T, VL: S34R_S57Y_F103V)_ huIgG1z mAb(LC: G37A_K38R_M107L) DNA | GATACTGTGATGACCCAGACTCCACTCTCTCTGTCCGTCACCCC TGGACAGCCGGCCTCCATCTCCTGCAAGTCTAGTCAGAGCCTCC TACATAGAGATGCCAGAACCTATTTGTTTTGGTACCTGCAGAAG CCAGGCCAGCCTCCACAGCTCCTGATCTACGAAGTTTCCAACCG GTTCTCTGGAGTGCCAGATAGGTTCAGTGGCAGCGGGTCAGGGA CAGATTTCACACTGAAAATCAGCCGTGTGGAGGCTGAGGATGTT GGGGTGTATTACTGCCTGCAAAGTTTACGGCTTCCGCTCACTTT CGGCGGAGGGACCAAGGTGGAGATCAAACGAACGGTGGCTGCAC CATCTGTCTTCATCTTCCCGCCATCTGATGAGCAGTTGAAATCT GGAACTGCCTCTGTTGTGTGCCTGCTGAATAACTTCTATCCCAG AGAGGCCAAAGTACAGTGGAAGGTGGATAACGCCCTCCAATCGG GTAACTCCCAGGAGAGTGTCACAGAGCAGGACAGCAAGGACAGC ACCTACAGCCTCAGCAGCACCCTGACGCTGAGCAAAGCAGACTA CGAGAAACACAAAGTCTACGCCTGCGAAGTCACCCATCAGGGCC TGAGCTCGCCCGTCACAAAGAGCTTCAACAGGGGAGAGTGTTAG |
| 624 | Antibody 5.7 IgG1 HC (VH: A71S_D72R, VL: S57Y_E58L_ V67S_F103V)_huIgG1z mAb(LC: G37A_K38R_M107L) DNA | CAGGTGCAGCTGGTGGAGTCTGGGGGAGGCGTGGTCCAGCCTGG GAGGTCCCTGAGACTCTCCTGTGCAGCCTCTGGATTCACCTTCA GTAGCTATGGCATGCACTGGGTCCGCCAGGCTCCAGGCAAGGGG CTGGAGTGGGTGGCAGTTATCTCATATGATGGAAGTAATAAATA CTATAGCAGATCCGTGAAGGGCCGATTCACCATCTCCAGAGACA ATTCCAAGAACACGCTGTATCTGCAAATGAACAGCCTGAGAGCT GAGGACACGGCTGTGTATTACTGTGCGAGGGGGCGATATTTTGA CTGGTTCCTCTTTTGACTACTGGGGCCAGGGAACCCTGGTCACCG TGTCCTCAGCCTCCACCAAGGGCCCATCGGTCTTCCCCCTGGCA CCCTCCTCCAAGAGCACCTCTGGGGGCACAGCGGCCCTGGGCTG CCTGGTCAAGGACTACTTCCCCGAACCGGTGACGGTGTCGTGGA ACTCAGGCGCCCTGACCAGCGGCGTGCACACCTTCCCGGCTGTC CTACAGTCCTCAGGACTCTACTCCCTCAGCAGCGTGGTGACCGT GCCCTCCAGCAGCTTGGGCACCCAGACCTACATCTGCAACGTGA ATCACAAGCCCAGCAACACCAAGGTGGACAAGAAAGTTGAGCCC AAATCTTGTGACAAAACTCACACATGCCCACCGTGCCCAGCACC TGAACTCCTGGGGGGACCGTCAGTCTTCCTCTTCCCCCCAAAAC CCAAGGACACCCTCATGATCTCCCGGACCCCTGAGGTCACATGC GTGGTGGTGGACGTGAGCCACGAAGACCCTGAGGTCAAGTTCAA CTGGTACGTGGACGGCGTGGAGGTGCATAATGCCAAGACAAAGC CGCGGGAGGAGCAGTACAACAGCACGTACCGTGTGGTCAGCGTC CTCACCGTCCTGCACCAGGACTGGCTGAATGGCAAGGAGTACAA GTGCAAGGTGTCCAACAAAGCCCTCCCAGCCCCCATCGAGAAAA CCATCTCCAAAGCCAAAGGGCAGCCCCGAGAACCACAGGTGTAC ACCCTGCCCCCATCCCGGGAGGAGATGACCAAGAACCAGGTCAG CCTGACCTGCCTGGTCAAAGGCTTCTATCCCAGCGACATCGCCG TGGAGTGGGAGAGCAATGGGCAGCCGGAGAACAACTACAAGACC ACGCCTCCCGTGCTGGACTCCGACGGCTCCTTCTTCCTCTATAG CAAGCTCACCGTGGACAAGAGCAGGTGGCAGCAGGGGAACGTCT TCTCATGCTCCGTGATGCATGAGGCTCTGCACAACCACTACACG CAGAAGAGCCTCTCCCTGTCTCCGGGCAAATAG |
| 625 | Antibody 5.7 IgG1 LC (VH: A71_S_D72R, VL: S57Y_E58L_ V67S_F103V)_huIgG1z mAb(LC: G37A_K38R_M107L) DNA | GATACTGTGATGACCCAGACTCCACTCTCTCTGTCCGTCACCCC TGGACAGCCGGCCTCCATCTCCTGCAAGTCTAGTCAGAGCCTCC TACATAGTGATGCCAGAACCTATTTGTTTTGGTACCTGCAGAAG CCAGGCCAGCCTCCACAGCTCCTGATCTACCTGAGCTCCAACCG GTTCTCTGGAGTGCCAGATAGGTTCAGTGGCAGCGGGTCAGGGA CAGATTTCACACTGAAAATCAGCCGTGTGGAGGCTGAGGATGTT GGGGTGTATTACTGCCTGCAAAGTTTACGGCTTCCGCTCACTTT CGGCGGAGGGACCAAGGTGGAGATCAAACGAACGGTGGCTGCAC CATCTGTCTTCATCTTCCCGCCATCTGATGAGCAGTTGAAATCT GGAACTGCCTCTGTTGTGTGCCTGCTGAATAACTTCTATCCCAG AGAGGCCAAAGTACAGTGGAAGGTGGATAACGCCCTCCAATCGG GTAACTCCCAGGAGAGTGTCACAGAGCAGGACAGCAAGGACAGC ACCTACAGCCTCAGCAGCACCCTGACGCTGAGCAAAGCAGACTA CGAGAAACACAAAGTCTACGCCTGCGAAGTCACCCATCAGGGCC TGAGCTCGCCCGTCACAAAGAGCTTCAACAGGGGAGAGTGTTAG |
| 626 | Antibody 5.8 IgG1 HC (VH: G40PF134T, VL: S5_7YE5_8L_ V67R_F103V)_huIgG1z mAb(LC: G37A_K38R_M107L) DNA | CAGGTGCAGCTGGTGGAGTCTGGGGGAGGCGTGGTCCAGCCTGG GAGGTCCCTGAGACTCTCCTGTGCAGCCTCTGGATTCACCTTCA GTAGCTATCCCATGCACTGGGTCCGCCAGGCTCCAGGCAAGGGG CTGGAGTGGGTGGCAGTTATCTCATATGATGGAAGTAATAAATA CTATGCAGACTCCGTGAAGGGCCGATTCACCATCTCCAGAGACA ATTCCAAGAACACGCTGTATCTGCAAATGAACAGCCTGAGAGCT GAGGACACGGCTGTGTATTACTGTGCGAGGGGGCGATATTTTGA CTGGACCCTCTTTTGACTACTGGGGCCAGGGAACCCTGGTCACCG TGTCCTCAGCCTCCACCAAGGGCCCATCGGTCTTCCCCCTGGCA CCCTCCTCCAAGAGCACCTCTGGGGGCACAGCGGCCCTGGGCTG CCTGGTCAAGGACTACTTCCCCGAACCGGTGACGGTGTCGTGGA |

TABLE 18-continued

Exemplary nucleic acid sequences that encode antibodies of the present invention.

| SEQ ID NO: | Designation | Sequence |
|---|---|---|
| | | ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 627 | Antibody 5.8 IgG1 LC<br>(VH: G40P_F134T, VL: S57Y_E58L_<br>V67R_F103V)_huIgG1z<br>mAb(LC: G37A_K38R_M107L) DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGTGATGCCAGAACCTATTTGTTTTGGTACCTGCAGAAG<br>CCAGGCCAGCCTCCACAGCTCCTGATCTACCTGAGATCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGGTGTATTACTGCCTGCAAAGTTTACGGCTTCCGCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 628 | Antibody 5.9 IgG1 HC<br>(VH: G40A, VL: S57Y_E58L_V67T_<br>F103V)_huIgG1z<br>mAb(LC: G37A_K38R_M107L) DNA | CAGGTGCAGCTGGTGGAGTCTGGGGGAGGCGTGGTCCAGCCTGG<br>GAGGTCCCTGAGACTCTCCTGTGCAGCCTCTGGATTCACCTTCA<br>GTAGCTATGCCATGCACTGGGTCCGCCAGGCTCCAGGCAAGGGG<br>CTGGAGTGGGTGGCAGTTATCTCATATGATGGAAGTAATAAATA<br>CTATGCAGACTCCGTGAAGGGCCGATTCACCATCTCCAGAGACA<br>ATTCCAAGAACACGCTGTATCTGCAAATGAACAGCCTGAGAGCT<br>GAGGACACGGCTGTGTATTACTGTGCGAGGGGGCGATATTTTGA<br>CTGGTTCCTCTTTGACTACTGGGGCCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 629 | Antibody 5.9 IgG1 LC<br>(VH: G40A, VL: S57Y_E58L_V67T_<br>F103V)_huIgG1z<br>mAb(LC: G37A_K38R_M107L) DNA | GATACTGTGATGACCCAGACTCCACTCTCTCTGTCCGTCACCCC<br>TGGACAGCCGGCCTCCATCTCCTGCAAGTCTAGTCAGAGCCTCC<br>TACATAGTGATGCCAGAACCTATTTGTTTTGGTACCTGCAGAAG<br>CCAGGCCAGCCTCCACAGCTCCTGATCTACCTGACTCCAACCG<br>GTTCTCTGGAGTGCCAGATAGGTTCAGTGGCAGCGGGTCAGGGA<br>CAGATTTCACACTGAAAATCAGCCGTGTGGAGGCTGAGGATGTT<br>GGGGTGTATTACTGCCTGCAAAGTTTACGGCTTCCGCTCACTTT |

TABLE 18-continued

Exemplary nucleic acid sequences that encode antibodies of the present invention.

| SEQ ID NO: | Designation | Sequence |
|---|---|---|
| | | CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 630 | Antibody 6.0 IgG1 HC DNA | CAGGTGCAGCTGGTGGAGTCTGGGGGAGGCGTGGTCCAGCCTGG<br>GAGGTCCCTGAGACTCTCCTGTGAAGCCTCTGGATTCACCTTCA<br>GTAGCTATGTCATGCACTGGGTCCGCCAGGCTCCAGGCAAGGGG<br>CTGGAGTGGGTGTCAGTTATATCATATGATGGAAGTAGTCAATA<br>CTATACAGACTCCGTGAAGGGCCGATTCACCATCTCCAGAGACA<br>ATTCCAAGAATACGCTGAATCTGCAAATGAACAGCCTGAGAGCT<br>GAGGACACGGCTGTGTATTACTGTGTGAGAGGCCGTTTGGCCAC<br>TGCTATCCTCTTTGACTACTGGGGCCAGGGAACCCTGGTCACCG<br>TCTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 631 | Antibody 6.0 IgG1 LC DNA | GATATTTTGATGACCCAGACTCCACTCTCTCTGTCCGTCACCCC<br>TGGACAGCCGGCCTCCATCTCCTGCAAGTCTAGCCAGAGCCTCC<br>TATATAGTGATGGAAAGACCTATTTATTTTGGTACCTGCAGAGG<br>CCAGGCCAACCTCCACAGCTCCTGATCTATGAAGTTTCCAACCG<br>GTTCTCTGGAGTGCCAGATAGGTTCAGTGGCAGCGGGTCAGGGA<br>CAGATTTCACACTGAAAATCAGCCGGGTGGAGGCTGAGGATGTT<br>GGGATTTATTACTGCATGCAAAGTATAAAACTTCCTCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 632 | Antibody 6.1 IgG1 HC (VH: S67R_A114S_I134P, VL: F71L)_ huIgG1z mAb DNA | CAGGTGCAGCTGGTGGAGTCTGGGGGAGGCGTGGTCCAGCCTGG<br>GAGGTCCCTGAGACTCTCCTGTGAAGCCTCTGGATTCACCTTCA<br>GTAGCTATGTCATGCACTGGGTCCGCCAGGCTCCAGGCAAGGGG<br>CTGGAGTGGGTGTCAGTTATCTCATATGATGGAAGTAGACAATA<br>CTATACAGACTCCGTGAAGGGCCGATTCACCATCTCCAGAGACA<br>ATTCCAAGAATACGCTGAATCTGCAAATGAACAGCCTGAGAGCT<br>GAGGACACGGCTGTGTATTACTGTGTGAGAGGCCGTTTGGCCAC<br>TAGCCCCCTCTTTGACTACTGGGGCCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA |

TABLE 18-continued

Exemplary nucleic acid sequences that encode antibodies of the present invention.

| SEQ ID NO: | Designation | Sequence |
|---|---|---|
| | | CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 633 | Antibody 6.1 IgG1 LC<br>(VH: S67R_A114S_I134P, VL: F71L)_<br>huIgG1z mAb DNA | GATATTTTGATGACCCAGACTCCACTCTCTCTGTCCGTCACCCC<br>TGGACAGCCGGCCTCCATCTCCTGCAAGTCTAGCCAGAGCCTCC<br>TATATAGTGATGGAAAGACCTATTTATTTTGGTACCTGCAGAGG<br>CCAGGCCAACCTCCACAGCTCCTGATCTATGAAGTTTCCAACCG<br>GCTGTCTGGAGTGCCAGATAGGTTCAGTGGCAGCGGGTCAGGGA<br>CAGATTTCACACTGAAAATCAGCCGGGTGGAGGCTGAGGATGTT<br>GGGATTTATTACTGCATGCAAAGTATCAAACTTCCTCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC<br>ACCTACAGCCTCAGCAGCACCCTGACGCTGAGCAAAGCAGACTA<br>CGAGAAACACAAAGTCTACGCCTGCGAAGTCACCCATCAGGGCC<br>TGAGCTCGCCCGTCACAAAGAGCTTCAACAGGGGAGAGTGTTAG |
| 634 | Antibody 6.2 IgG1 HC<br>(VH: S67R_Q68A_L135K_F136L, VL:<br>S109T_I110L)_huIgG1z mAb DNA | CAGGTGCAGCTGGTGGAGTCTGGGGGAGGCGTGGTCCAGCCTGG<br>GAGGTCCCTGAGACTCTCCTGTGAAGCCTCTGGATTCACCTTCA<br>GTAGCTATGTCATGCACTGGGTCCGCCAGGCTCCAGGCAAGGGG<br>CTGGAGTGGGTGTCAGTTATCTCATATGATGGAAGTAGAGCCTA<br>CTATACAGACTCCGTGAAGGGCCGATTCACCATCTCCAGAGACA<br>ATTCCAAGAATACGCTGAATCTGCAAATGAACAGCCTGAGAGCT<br>GAGGACACGGCTGTGTATTACTGTGTGAGAGGCCGTTTGGCCAC<br>TGCTATCAAGCTGGACTACTGGGGCCAGGGAACCCTGGTCACCG<br>TGTCCTCAGCCTCCACCAAGGGCCCATCGGTCTTCCCCCTGGCA<br>CCCTCCTCCAAGAGCACCTCTGGGGGCACAGCGGCCCTGGGCTG<br>CCTGGTCAAGGACTACTTCCCCGAACCGGTGACGGTGTCGTGGA<br>ACTCAGGCGCCCTGACCAGCGGCGTGCACACCTTCCCGGCTGTC<br>CTACAGTCCTCAGGACTCTACTCCCTCAGCAGCGTGGTGACCGT<br>GCCCTCCAGCAGCTTGGGCACCCAGACCTACATCTGCAACGTGA<br>ATCACAAGCCCAGCAACACCAAGGTGGACAAGAAAGTTGAGCCC<br>AAATCTTGTGACAAAACTCACACATGCCCACCGTGCCCAGCACC<br>TGAACTCCTGGGGGGACCGTCAGTCTTCCTCTTCCCCCCAAAAC<br>CCAAGGACACCCTCATGATCTCCCGGACCCCTGAGGTCACATGC<br>GTGGTGGTGGACGTGAGCCACGAAGACCCTGAGGTCAAGTTCAA<br>CTGGTACGTGGACGGCGTGGAGGTGCATAATGCCAAGACAAAGC<br>CGCGGGAGGAGCAGTACAACAGCACGTACCGTGTGGTCAGCGTC<br>CTCACCGTCCTGCACCAGGACTGGCTGAATGGCAAGGAGTACAA<br>GTGCAAGGTGTCCAACAAAGCCCTCCCAGCCCCCATCGAGAAAA<br>CCATCTCCAAAGCCAAAGGGCAGCCCCGAGAACCACAGGTGTAC<br>ACCCTGCCCCATCCCGGGAGGAGATGACCAAGAACCAGGTCAG<br>CCTGACCTGCCTGGTCAAAGGCTTCTATCCCAGCGACATCGCCG<br>TGGAGTGGGAGAGCAATGGGCAGCCGGAGAACAACTACAAGACC<br>ACGCCTCCCGTGCTGGACTCCGACGGCTCCTTCTTCCTCTATAG<br>CAAGCTCACCGTGGACAAGAGCAGGTGGCAGCAGGGGAACGTCT<br>TCTCATGCTCCGTGATGCATGAGGCTCTGCACAACCACTACACG<br>CAGAAGAGCCTCTCCCTGTCTCCGGGCAAATAG |
| 635 | Antibody 6.2 IgG1 LC<br>(VH: S67R_Q68A_L135K_F136L, VL:<br>S109T_I110L)_huIgG1z mAb DNA | GATATTTTGATGACCCAGACTCCACTCTCTCTGTCCGTCACCCC<br>TGGACAGCCGGCCTCCATCTCCTGCAAGTCTAGCCAGAGCCTCC<br>TATATAGTGATGGAAAGACCTATTTATTTTGGTACCTGCAGAGG<br>CCAGGCCAACCTCCACAGCTCCTGATCTATGAAGTTTCCAACCG<br>GTTCTCTGGAGTGCCAGATAGGTTCAGTGGCAGCGGGTCAGGGA<br>CAGATTTCACACTGAAAATCAGCCGGGTGGAGGCTGAGGATGTT<br>GGGATTTATTACTGCATGCAAACCCTGAAACTTCCTCTCACTTT<br>CGGCGGAGGGACCAAGGTGGAGATCAAACGAACGGTGGCTGCAC<br>CATCTGTCTTCATCTTCCCGCCATCTGATGAGCAGTTGAAATCT<br>GGAACTGCCTCTGTTGTGTGCCTGCTGAATAACTTCTATCCCAG<br>AGAGGCCAAAGTACAGTGGAAGGTGGATAACGCCCTCCAATCGG<br>GTAACTCCCAGGAGAGTGTCACAGAGCAGGACAGCAAGGACAGC |

TABLE 18-continued

Exemplary nucleic acid sequences that encode antibodies of the present invention.

| SEQ ID NO: | Designation | Sequence |
|---|---|---|
| | | ACCTACAGCCTCAGCAGCACCCTGACGCTGAGCAAAGCAGACTA CGAGAAACACAAAGTCTACGCCTGCGAAGTCACCCATCAGGGCC TGAGCTCGCCCGTCACAAAGAGCTTCAACAGGGGAGAGTGTTAG | zeluvalimab HC without C-terminal lysine
(SEQ ID NO: 636)
EVQLLESGGGLVQPGGSLRLSCAASGFTFSSYDMSWVRQAPGKGLEWVS
LISGGGSQTYYAESVKGRFTISRDNSKNTLYLQMNSLRAEDTAVYFCAS
PSGHYFYAMDVWGQGTTVTVSSASTKGPSVFPLAPSSKSTSGGTAALGC
LVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFL
FPPKPKDTLMISRTPEVTCVVVDVSHEDPEVKFNWYVDGVEVHNAKTKP
CEEQYGSTYRCVSVLTVLHQDWLNGKEYKCKVSNKALPAPIEKTISKAK
GQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQ
KSLSLSPG

TABLE 19

Amino acid sequences of afucosyated CCR8 mIgG2a antibody.

| SEQ ID NO: | Designation | Sequence |
|---|---|---|
| 637 | CCR8 mIgG2a LCDR1 | KYSQSLLHSDGKTYLF |
| 638 | CCR8 mIgG2a LCDR2 | EVSNRFS |
| 639 | CCR8 mIgG2a LCDR3 | MQTLKLPLT |
| 640 | CCR8 mIgG2a HCDR1 | NYGMH |
| 641 | CCR8 mIgG2a HCDR2 | VISYDGSRNFYADSVKG |
| 642 | CCR8 mIgG2a HCDR3 | AGGNGRFDY |
| 643 | CCR8 mIgG2a LCVR 1 | DIVMTQTPLSLSVTPGQPASISCKYSQSLLHS DGKTYLFWYLQKPGQSPQLLIYEVSNRFSGV PDRFSGSGSGTDFTLKISRVEAEDVGVYYCM QTLKLPLTFGGGTKVEIKR |
| 644 | CCR8 mIgG2a HCVR | QVQLVESGGGVVQPGRSLRLSCAASGFTFSN YGMHWVRQAPGKGLEWVAVISYDGSRNFY ADSVKGRFTISRDNSKNTLYLQMNSLRAEDT AVYYCARAGGNGRFDYWGQGTLVTVSS |
| 645 | CCR8 mIgG2a LC | DIVMTQTPLSLSVTPGQPASISCKYSQSLLHS DGKTYLFWYLQKPGQSPQLLIYEVSNRFSGV PDRFSGSGSGTDFTLKISRVEAEDVGVYYCM QTLKLPLTFGGGTKVEIKRADAAPTVSIFPPS SEQLTSGGASVVCFLNNFYPKDINVKWKIDG SERQNGVLNSWTDQDSKDSTYSMSSTLTLTK DEYERHNSYTCEATHKTSTSPIVKSFNRNEC |
| 646 | CCR8 mIgG2aHC | QVQLVESGGGVVQPGRSLRLSCAASGFTFSN YGMHWVRQAPGKGLEWVAVISYDGSRNFY ADSVKGRFTISRDNSKNTLYLQMNSLRAEDT AVYYCARAGGNGRFDYWGQGTLVTVSSAK TTAPSVYPLAPVCGDTTGSSVTLGCLVKGYF PEPVTLTWNSGSLSSGVHTFPAVLQSDLYTLS SSVTVTSSTWPSQSITCNVAHPASSTKVDKKI EPRGPTIKPCPPCKCPAPNLLGGPSVFIPPPKIK DVLMISLSPIVTCVVVDVSEDDPDVQISWFV NNVEVHTAQTQTHREDYNSTLRVVSALPIQH QDWMSGKEFKCKVNNKDLPAPIERTISKPKG SVRAPQVYVLPPPEEEMTKKQVTLTCMVTD FMPEDIYVEWTNNGKTELNYKNTEPVLDSD GSYFMYSKLRVEKKNWVERNSYSCSVHEG LHNHHTTKSFSRTPGK |

TABLE 20

Amino acid sequences.

| SEQ ID NO: | Designation | Sequence |
|---|---|---|
| 647 | MPK20298-A4_SCFV huCCR8 HV hv_cdr1 | NNGMH |
| 648 | MPK20298-A4_SCFV huCCR8 HV hv_cdr2 | VISNDGSNKYYADSVKG |
| 649 | MPK20298-A4_SCFV huCCR8 HV hv_cdr3 | VYYGSGIYYKNRNYYGMDV |
| 650 | MPK20298-A4_SCFV huCCR8 LV lv_cdr1 | GGNNIGSQNVH |
| 651 | MPK20298-A4_SCFV huCCR8 LV lv_cdr2 | RDSNRPS |
| 652 | MPK20298-A4_SCFV huCCR8 LV lv_cdr3 | QVWDSSTVV |
| 653 | MPK20299-D2_SCFV huCCR8 HV hv_cdr1 | NYGMH |
| 654 | MPK20299-D2_SCFV huCCR8 HV hv_cdr2 | VISYDGSNKYYADSVKG |
| 655 | MPK20299-D2_SCFV huCCR8 HV hv_cdr3 | VYYGSGIYYKKRYYYGMDV |
| 656 | MPK20299-D2_SCFV huCCR8 LV lv_cdr1 | GGHNIGSKGVH |
| 657 | MPK20299-D2_SCFV huCCR8 LV lv_cdr2 | RNSNRPS |
| 658 | MPK20299-D2_SCFV huCCR8 LV lv_cdr3 | QVWDSSTVV |
| 659 | MPK20299-F11_SCFV huCCR8 HV hv_cdr1 | NYGMH |
| 660 | MPK20299-F11_SCFV huCCR8 HV hv_cdr2 | VISYDGSNKYYADSVKG |
| 661 | MPK20299-F11_SCFV huCCR8 HV hv_cdr3 | VYYGSGSYYKKRYYYGMDV |
| 662 | MPK20299-F11_SCFV huCCR8 LV lv_cdr1 | GGNNIGSQNVH |
| 663 | MPK20299-F11_SCFV huCCR8 LV lv_cdr2 | RDSNRPS |
| 664 | MPK20299-F11_SCFV huCCR8 LV lv_cdr3 | QVWDSSTVV |
| 665 | MPK20298-H6_SCFV huCCR8 HV hv_cdr1 | SSGMH |
| 666 | MPK20298-H6_SCFV huCCR8 HV hv_cdr2 | VISYDGTNKYYADSVKG |
| 667 | MPK20298-H6_SCFV huCCR8 HV hv_cdr3 | VYYGSGIYYKNRYYYGMDV |
| 668 | MPK20298-H6_SCFV huCCR8 LV lv_cdr1 | GGHNIGSKGVH |
| 669 | MPK20298-H6_SCFV huCCR8 LV lv_cdr2 | RNSNRPS |
| 670 | MPK20298-H6_SCFV huCCR8 LV lv_cdr3 | QVWDSSTVV |
| 671 | MPK20297-A4_SCFV huCCR8 HV hv_cdr1 | NYGMH |
| 672 | MPK20297-A4_SCFV huCCR8 HV hv_cdr2 | VISNDGSNKYYADSVKG |
| 673 | MPK20297-A4_SCFV huCCR8 HV hv_cdr3 | VYYGSGIYYKKRYYYGMDV |
| 674 | MPK20297-A4_SCFV huCCR8 LV lv_cdr1 | GGHNIGSQNVH |
| 675 | MPK20297-A4_SCFV huCCR8 LV lv_cdr2 | RDSNRPS |
| 676 | MPK20297-A4_SCFV huCCR8 LV lv_cdr3 | QVWDSSTVV |
| 677 | MPK20299-H8_SCFV huCCR8 HV hv_cdr1 | NYGMH |
| 678 | MPK20299-H8_SCFV huCCR8 HV hv_cdr2 | VISYDGSNKYYADSVKG |
| 679 | MPK20299-H8_SCFV huCCR8 HV hv_cdr3 | VYYGSGIYYKKRYYYGMDV |
| 680 | MPK20299-H8_SCFV huCCR8 LV lv_cdr1 | GGNNIGSKNVH |
| 681 | MPK20299-H8_SCFV huCCR8 LV lv_cdr2 | RNSNRPS |
| 682 | MPK20299-H8_SCFV huCCR8 LV lv_cdr3 | QVWDSSTVV |
| 683 | MPK20300-C11_SCFV huCCR8 HV hv_cdr1 | SYGMH |

TABLE 20-continued

Amino acid sequences.

| SEQ ID NO: | Designation | Sequence |
|---|---|---|
| 684 | MPK20300-C11_SCFV huCCR8 HV hv_cdr2 | VISYDGSNKYYADSVKG |
| 685 | MPK20300-C11_SCFV huCCR8 HV hv_cdr3 | VYYGSGSYYKNRYYYGMDV |
| 686 | MPK20300-C11_SCFV huCCR8 LV lv_cdr1 | GGNNIGSKNVH |
| 687 | MPK20300-C11_SCFV huCCR8 LV lv_cdr2 | RDINRPS |
| 688 | MPK20300-C11_SCFV huCCR8 LV lv_cdr3 | QVWDSSVV |
| 689 | MPK20298-B1_SCFV huCCR8 HV hv_cdr1 | NYGMH |
| 690 | MPK20298-B1_SCFV huCCR8 HV hv_cdr2 | VISYDGSNKYYADSVKG |
| 691 | MPK20298-B1_SCFV huCCR8 HV hv_cdr3 | VYYGSGIYYKKRYYYGMDV |
| 692 | MPK20298-B1_SCFV huCCR8 LV lv_cdr1 | EGNNIGSKNVH |
| 693 | MPK20298-B1_SCFV huCCR8 LV lv_cdr2 | RNSNRPS |
| 694 | MPK20298-B1_SCFV huCCR8 LV lv_cdr3 | QAWDSSTVV |
| 695 | MPK20297-E5_SCFV huCCR8 HV hv_cdr1 | NNGMH |
| 696 | MPK20297-E5_SCFV huCCR8 HV hv_cdr2 | VISYDGSNKYYTDSVKG |
| 697 | MPK20297-E5_SCFV huCCR8 HV hv_cdr3 | VYYGSGIYYKKRYYYGMDV |
| 698 | MPK20297-E5_SCFV huCCR8 LV lv_cdr1 | GGNNIGSKNVH |
| 699 | MPK20297-E5_SCFV huCCR8 LV lv_cdr2 | RDSNRPS |
| 700 | MPK20297-E5_SCFV huCCR8 LV lv_cdr3 | QVWDSSSDHVV |
| 701 | MPK20299-A3_SCFV huCCR8 HV hv_cdr1 | NYGMH |
| 702 | MPK20299-A3_SCFV huCCR8 HV hv_cdr2 | VISYDGSNKYYADSVKG |
| 703 | MPK20299-A3_SCFV huCCR8 HV hv_cdr3 | VYYGSGIYYKKRYYYGMDV |
| 704 | MPK20299-A3_SCFV huCCR8 LV lv_cdr1 | GGNNIGSKNVH |
| 705 | MPK20299-A3_SCFV huCCR8 LV lv_cdr2 | RNSNRPS |
| 706 | MPK20299-A3_SCFV huCCR8 LV lv_cdr3 | QAWDSSNVV |
| 707 | MPK20297-B4_SCFV huCCR8 HV hv_cdr1 | RNGMH |
| 708 | MPK20297-B4_SCFV huCCR8 HV hv_cdr2 | VISNDGSNKYYADSVKG |
| 709 | MPK20297-B4_SCFV huCCR8 HV hv_cdr3 | VYYGSGIYYKNNYYYGMDV |
| 710 | MPK20297-B4_SCFV huCCR8 LV lv_cdr1 | GGNNIGSQNVH |
| 711 | MPK20297-B4_SCFV huCCR8 LV lv_cdr2 | RDSNRPS |
| 712 | MPK20297-B4_SCFV huCCR8 LV lv_cdr3 | QVWDSSTVV |
| 713 | MPK20298-F6_SCFV huCCR8 HV hv_cdr1 | RNGMH |
| 714 | MPK20298-F6_SCFV huCCR8 HV hv_cdr2 | VISNDGSNKYYADSVKG |
| 715 | MPK20298-F6_SCFV huCCR8 HV hv_cdr3 | VYYGSGIYYKNRYYYGMDV |
| 716 | MPK20298-F6_SCFV huCCR8 LV lv_cdr1 | GGNNIGSKNVH |
| 717 | MPK20298-F6_SCFV huCCR8 LV lv_cdr2 | RDSNRPS |
| 718 | MPK20298-F6_SCFV huCCR8 LV lv_cdr3 | QVWDSSTVV |
| 719 | MPK20299-H3_SCFV huCCR8 HV hv_cdr1 | NYGMH |
| 720 | MPK20299-H3_SCFV huCCR8 HV hv_cdr2 | VISYDGSNKYYADSVKG |

TABLE 20-continued

Amino acid sequences.

| SEQ ID NO: | Designation | Sequence |
|---|---|---|
| 721 | MPK20299-H3_SCFV huCCR8 HV hv_cdr3 | VYYGSGIYYKKRYYYGMDV |
| 722 | MPK20299-H3_SCFV huCCR8 LV lv_cdr1 | GGNNIGSKNVH |
| 723 | MPK20299-H3_SCFV huCCR8 LV lv_cdr2 | RNSNRPS |
| 724 | MPK20299-H3_SCFV huCCR8 LV lv_cdr3 | QIWDSSTVV |
| 725 | MPK20298-B9_SCFV huCCR8 HV hv_cdr1 | RNGMH |
| 726 | MPK20298-B9_SCFV huCCR8 HV hv_cdr2 | VISNDGSNKYYADSVKG |
| 727 | MPK20298-B9_SCFV huCCR8 HV hv_cdr3 | VYYGSGIYYKKNYYYGMDV |
| 728 | MPK20298-B9_SCFV huCCR8 LV lv_cdr1 | GGNNIGSKNVH |
| 729 | MPK20298-B9_SCFV huCCR8 LV lv_cdr2 | RDSNRPS |
| 730 | MPK20298-B9_SCFV huCCR8 LV lv_cdr3 | QVWDSSTVV |
| 731 | MPK20299-E2_SCFV huCCR8 HV hv_cdr1 | NNGMH |
| 732 | MPK20299-E2_SCFV huCCR8 HV hv_cdr2 | VISYDGSNKYYTDSVKG |
| 733 | MPK20299-E2_SCFV huCCR8 HV hv_cdr3 | VYYGSGIYYKKRYYYGMDV |
| 734 | MPK20299-E2_SCFV huCCR8 LV lv_cdr1 | EGNNIGSQNVH |
| 735 | MPK20299-E2_SCFV huCCR8 LV lv_cdr2 | RDSNRPS |
| 736 | MPK20299-E2_SCFV huCCR8 LV lv_cdr3 | QVWDGSAVV |
| 737 | MPK20299-D6_SCFV huCCR8 HV hv_cdr1 | SYGMH |
| 738 | MPK20299-D6_SCFV huCCR8 HV hv_cdr2 | VISYDGSNKYYADSVKG |
| 739 | MPK20299-D6_SCFV huCCR8 HV hv_cdr3 | VYYGSGIYYKKRYYYGMDV |
| 740 | MPK20299-D6_SCFV huCCR8 LV lv_cdr1 | EGNNIGSQNVH |
| 741 | MPK20299-D6_SCFV huCCR8 LV lv_cdr2 | RDSNRPS |
| 742 | MPK20299-D6_SCFV huCCR8 LV lv_cdr3 | QVWDGSAVV |
| 743 | MPK20299-A4_SCFV huCCR8 HV hv_cdr1 | NYGFH |
| 744 | MPK20299-A4_SCFV huCCR8 HV hv_cdr2 | VISYDGSNRYYADSVKG |
| 745 | MPK20299-A4_SCFV huCCR8 HV hv_cdr3 | VYYGSGTYYKNRYYYGMDV |
| 746 | MPK20299-A4_SCFV huCCR8 LV lv_cdr1 | GGHNIGSKGVH |
| 747 | MPK20299-A4_SCFV huCCR8 LV lv_cdr2 | RNSNRPS |
| 748 | MPK20299-A4_SCFV huCCR8 LV lv_cdr3 | QAWDSGTVV |
| 749 | MPK20300-G5_SCFV huCCR8 HV hv_cdr1 | NYGFH |
| 750 | MPK20300-G5_SCFV huCCR8 HV hv_cdr2 | VISYDGSNRYYADSVKG |
| 751 | MPK20300-G5_SCFV huCCR8 HV hv_cdr3 | VYYGSGTYYKNRYYYGMDV |
| 752 | MPK20300-G5_SCFV huCCR8 LV lv_cdr1 | GANNIGSKNVH |
| 753 | MPK20300-G5_SCFV huCCR8 LV lv_cdr2 | RDFNRPS |
| 754 | MPK20300-G5_SCFV huCCR8 LV lv_cdr3 | QVWDSSTGNVV |
| 755 | MPK20299-C3_SCFV huCCR8 HV hv_cdr1 | NYGFH |
| 756 | MPK20299-C3_SCFV huCCR8 HV hv_cdr2 | VISYDGSNKYYADSVKG |
| 757 | MPK20299-C3_SCFV huCCR8 HV hv_cdr3 | VYYGSGSYYKNRYYYGMDV |

TABLE 20-continued

Amino acid sequences.

| SEQ ID NO: | Designation | Sequence |
|---|---|---|
| 758 | MPK20299-C3_SCFV huCCR8 LV lv_cdr1 | GGNNIGSKNVH |
| 759 | MPK20299-C3_SCFV huCCR8 LV lv_cdr2 | RDSNRPS |
| 760 | MPK20299-C3_SCFV huCCR8 LV lv_cdr3 | QVWDSSTVV |
| 761 | MPK20299-B7_SCFV huCCR8 HV hv_cdr1 | NYGMH |
| 762 | MPK20299-B7_SCFV huCCR8 HV hv_cdr2 | VISYDGSNKYYADSVKG |
| 763 | MPK20299-B7_SCFV huCCR8 HV hv_cdr3 | VYYGSGIYYKKRYYYGMDV |
| 764 | MPK20299-B7_SCFV huCCR8 LV lv_cdr1 | GGNNIGSKNVH |
| 765 | MPK20299-B7_SCFV huCCR8 LV lv_cdr2 | RDSNRPS |
| 766 | MPK20299-B7_SCFV huCCR8 LV lv_cdr3 | QVWDSSSAHVI |
| 767 | MPK20299-A5_SCFV huCCR8 HV hv_cdr1 | GYGMH |
| 768 | MPK20299-A5_SCFV huCCR8 HV hv_cdr2 | VISYDGSNKYYADSVKG |
| 769 | MPK20299-A5_SCFV huCCR8 HV hv_cdr3 | VYYGSGIYYKNRYYYGMDV |
| 770 | MPK20299-A5_SCFV huCCR8 LV lv_cdr1 | GGNNLGSKNVH |
| 771 | MPK20299-A5_SCFV huCCR8 LV lv_cdr2 | RNSNRPS |
| 772 | MPK20299-A5_SCFV huCCR8 LV lv_cdr3 | QVWDSSTVV |
| 773 | MPK20299-D1_SCFV huCCR8 HV hv_cdr1 | NNGMH |
| 774 | MPK20299-D1_SCFV huCCR8 HV hv_cdr2 | VISYDGSNKYYADSVKG |
| 775 | MPK20299-D1_SCFV huCCR8 HV hv_cdr3 | VYYGSGIYYKNRYYYGMDV |
| 776 | MPK20299-D1_SCFV huCCR8 LV lv_cdr1 | GGNRIGSKNVH |
| 777 | MPK20299-D1_SCFV huCCR8 LV lv_cdr2 | RDSNRPS |
| 778 | MPK20299-D1_SCFV huCCR8 LV lv_cdr3 | QVWDSSTVV |
| 779 | MPK20299-C5_SCFV huCCR8 HV hv_cdr1 | NYGFH |
| 780 | MPK20299-C5_SCFV huCCR8 HV hv_cdr2 | VISYDGSNRYYADSVKG |
| 781 | MPK20299-C5_SCFV huCCR8 HV hv_cdr3 | VYYGSGTYYKNRYYYGMDV |
| 782 | MPK20299-C5_SCFV huCCR8 LV lv_cdr1 | GGHNIGSKGVH |
| 783 | MPK20299-C5_SCFV huCCR8 LV lv_cdr2 | RNSNRPS |
| 784 | MPK20299-C5_SCFV huCCR8 LV lv_cdr3 | QVWDSSTVV |
| 785 | MPK20299-B5_SCFV huCCR8 HV hv_cdr1 | NYGMH |
| 786 | MPK20299-B5_SCFV huCCR8 HV hv_cdr2 | VISYDGSNKYYADSVKG |
| 787 | MPK20299-B5_SCFV huCCR8 HV hv_cdr3 | VYYGSGIYYKNRYYYGMDV |
| 788 | MPK20299-B5_SCFV huCCR8 LV lv_cdr1 | GGHNIGSKGVH |
| 789 | MPK20299-B5_SCFV huCCR8 LV lv_cdr2 | RNSNRPS |
| 790 | MPK20299-B5_SCFV huCCR8 LV lv_cdr3 | QVWDSSTVV |
| 791 | MPK20299-G9_SCFV huCCR8 HV hv_cdr1 | NNGMH |
| 792 | MPK20299-G9_SCFV huCCR8 HV hv_cdr2 | VISNDGSNKYYADSVRG |
| 793 | MPK20299-G9_SCFV huCCR8 HV hv_cdr3 | VYYGSGIYYKNRYYYGMDV |
| 794 | MPK20299-G9_SCFV huCCR8 LV lv_cdr1 | GGNNIGSKNVH |
| 795 | MPK20299-G9_SCFV huCCR8 LV lv_cdr2 | RNSNRPS |

TABLE 20-continued

Amino acid sequences.

| SEQ ID NO: | Designation | Sequence |
|---|---|---|
| 796 | MPK20299-G9_SCFV huCCR8 LV lv_cdr3 | QVWDSSTVV |
| 797 | MPK20299-G5_SCFV huCCR8 HV hv_cdr1 | NNGMH |
| 798 | MPK20299-G5_SCFV huCCR8 HV hv_cdr2 | VISNDGSNKYYADSVRG |
| 799 | MPK20299-G5_SCFV huCCR8 HV hv_cdr3 | VYYGSGIYYKNRYYYGMDV |
| 800 | MPK20299-G5_SCFV huCCR8 LV lv_cdr1 | EGNNIGSKNVH |
| 801 | MPK20299-G5_SCFV huCCR8 LV lv_cdr2 | RDSNRPS |
| 802 | MPK20299-G5_SCFV huCCR8 LV lv_cdr3 | QVWDSSAVV |
| 803 | MPK20298-C10_SCFV huCCR8 HV hv_cdr1 | SSGMH |
| 804 | MPK20298-C10_SCFV huCCR8 HV hv_cdr2 | VISNDGSNKYYADSVRG |
| 805 | MPK20298-C10_SCFV huCCR8 HV hv_cdr3 | VYYGSGIYYKNNYYYGMDV |
| 806 | MPK20298-C10_SCFV huCCR8 LV lv_cdr1 | GGNNIGSKNVH |
| 807 | MPK20298-C10_SCFV huCCR8 LV lv_cdr2 | RNSNRPS |
| 808 | MPK20298-C10_SCFV huCCR8 LV lv_cdr3 | QAWDSSTVV |
| 809 | MPK20298-B5_SCFV huCCR8 HV hv_cdr1 | NYGMH |
| 810 | MPK20298-B5_SCFV huCCR8 HV hv_cdr2 | VISYDGSNKYYADSVKG |
| 811 | MPK20298-B5_SCFV huCCR8 HV hv_cdr3 | VYYGSGIYYKKRYYYGMDV |
| 812 | MPK20298-B5_SCFV huCCR8 LV lv_cdr1 | GGNNIGSQNVH |
| 813 | MPK20298-B5_SCFV huCCR8 LV lv_cdr2 | RDSNRPS |
| 814 | MPK20298-B5_SCFV huCCR8 LV lv_cdr3 | QVWDSSAVV |
| 815 | MPK20299-F2_SCFV huCCR8 HV hv_cdr1 | SSGMH |
| 816 | MPK20299-F2_SCFV huCCR8 HV hv_cdr2 | VISNDGSNKYYADSVRG |
| 817 | MPK20299-F2_SCFV huCCR8 HV hv_cdr3 | VYYGSGIYYKNRYYYGMDV |
| 818 | MPK20299-F2_SCFV huCCR8 LV lv_cdr1 | GGNNIGSKNVH |
| 819 | MPK20299-F2_SCFV huCCR8 LV lv_cdr2 | RDSNRPS |
| 820 | MPK20299-F2_SCFV huCCR8 LV lv_cdr3 | QAWDSGTVV |
| 821 | MPK20298-D4_SCFV huCCR8 HV hv_cdr1 | NYGMH |
| 822 | MPK20298-D4_SCFV huCCR8 HV hv_cdr2 | VISYDGSNKYYADSVKG |
| 823 | MPK20298-D4_SCFV huCCR8 HV hv_cdr3 | VYYGSGIYYKKRYYYGMDV |
| 824 | MPK20298-D4_SCFV huCCR8 LV lv_cdr1 | GGNNIGGKNVH |
| 825 | MPK20298-D4_SCFV huCCR8 LV lv_cdr2 | RDSNRPS |
| 826 | MPK20298-D4_SCFV huCCR8 LV lv_cdr3 | QVWDSSTVV |
| 827 | MPK20297-F5_SCFV huCCR8 HV hv_cdr1 | RNGMH |
| 828 | MPK20297-F5_SCFV huCCR8 HV hv_cdr2 | VISNDGSNKYYADSVKG |
| 829 | MPK20297-F5_SCFV huCCR8 HV hv_cdr3 | VYYGSGIYYKNNYYYGMDV |
| 830 | MPK20297-F5_SCFV huCCR8 LV lv_cdr1 | GGNNIGSKNVH |
| 831 | MPK20297-F5_SCFV huCCR8 LV lv_cdr2 | RNSNRPS |

TABLE 20-continued

Amino acid sequences.

| SEQ ID NO: | Designation | Sequence |
|---|---|---|
| 832 | MPK20297-F5_SCFV huCCR8 LV lv_cdr3 | QVWDSSTVV |
| 833 | MPK20299-D9_SCFV huCCR8 HV hv_cdr1 | RNGMH |
| 834 | MPK20299-D9_SCFV huCCR8 HV hv_cdr2 | VISNDGSNKYYADSVKG |
| 835 | MPK20299-D9_SCFV huCCR8 HV hv_cdr3 | VYYGSGIYYKNNYYYGMDV |
| 836 | MPK20299-D9_SCFV huCCR8 LV lv_cdr1 | GGNNIESKNVH |
| 837 | MPK20299-D9_SCFV huCCR8 LV lv_cdr2 | RDSNRPS |
| 838 | MPK20299-D9_SCFV huCCR8 LV lv_cdr3 | QVWDSSTVV |
| 839 | huCCR8_32360_huIgG1z mAb(LC:K38R)_HC huCCR8 HV hv_cdr1 | NARMG |
| 840 | huCCR8_32360_huIgG1z mAb(LC:K38R)_HC huCCR8 HV hv_cdr2 | RIKSKTEGGTRDYAAPVKG |
| 841 | huCCR8_32360_huIgG1z mAb(LC:K38R)_HC huCCR8 HV hv_cdr3 | YSGV |
| 842 | huCCR8_32360_huIgG1z mAb(LC:K38R)_LC huCCR8 LV lv_cdr1 | KSSQSVLYSSNNRNYLA |
| 843 | huCCR8_32360_huIgG1z mAb(LC:K38R)_LC huCCR8 LV lv_cdr2 | WASTRES |
| 844 | huCCR8_32360_huIgG1z mAb(LC:K38R)_LC huCCR8 LV lv_cdr3 | QQYYSIPIT |
| 845 | anti-huCCR8_44379(VH:D72S, VL:N67A_S68A_M99G_W109F_S111A)_huIgG1z (mAb)_HC huCCR8 HV hv_cdr1 | NYGFH |
| 846 | anti-huCCR8_44379(VH:D72S, VL:N67A_S68A_M99G_W109F_S111A)_huIgG1z (mAb)_HC huCCR8 HV hv_cdr2 | VISYDGSNRYYASSVKG |
| 847 | anti-huCCR8_44379(VH:D72S, VL:N67A_S68A_M99G_W109F_S111A)_huIgG1z (mAb)_HC huCCR8 HV hv_cdr3 | VYYGSGTYYKNRYYYGMDV |
| 848 | anti-huCCR8_44379(VH:D72S, VL:N67A_S68A_M99G_W109F_S111A)_huIgG1z (mAb)_LC huCCR8 LV lv_cdr1 | GGHNIGSKGVH |
| 849 | anti-huCCR8_44379(VH:D72S, VL:N67A_S68A_M99G_W109F_S111A)_huIgG1z (mAb)_LC huCCR8 LV lv_cdr2 | RAANRPS |
| 850 | anti-huCCR8_44379(VH:D72S, VL:N67A_S68A_M99G_W109F_S111A)_huIgG1z (mAb)_LC huCCR8 LV lv_cdr3 | QAFDAGTVV |
| 851 | anti-huCCR8_44379(VH:D61A_D72A, VL:N67Q_M99E_W109F_S111A)_huIgG1z (mAb)_HC huCCR8 HV hv_cdr1 | NYGFH |
| 852 | anti-huCCR8_44379(VH:D61A_D72A, VL:N67Q_M99E_W109F_S111A)_huIgG1z (mAb)_HC huCCR8 HV hv_cdr2 | VISYAGSNRYYAASVKG |

TABLE 20-continued

Amino acid sequences.

| SEQ ID NO: | Designation | Sequence |
|---|---|---|
| 853 | anti-huCCR8_44379(VH:D61A_D72A, VL:N67Q_M99E_W109F_S111A)_huIgG1z (mAb)_HC huCCR8 HV hv_cdr3 | VYYGSGTYYKNRYYYGMDV |
| 854 | anti-huCCR8_44379(VH:D61A_D72A, VL:N67Q_M99E_W109F_S111A)_huIgG1z (mAb)_LC huCCR8 LV lv_cdr1 | GGHNIGSKGVH |
| 855 | anti-huCCR8_44379(VH:D61A_D72A, VL:N67Q_M99E_W109F_S111A)_huIgG1z (mAb)_LC huCCR8 LV lv_cdr2 | RQSNRPS |
| 856 | anti-huCCR8_44379(VH:D61A_D72A, VL:N67Q_M99E_W109F_S111A)_huIgG1z (mAb)_LC huCCR8 LV lv_cdr3 | QAFDAGTVV |
| 857 | anti-huCCR8_44379(VH:D61S, VL:N67Q_M99G_W109F_S111A)_huIgG1z (mAb)_HC huCCR8 HV hv_cdr1 | NYGFH |
| 858 | anti-huCCR8_44379(VH:D61S, VL:N67Q_M99G_W109F_S111A)_huIgG1z (mAb)_HC huCCR8 HV hv_cdr2 | VISYSGSNRYYADSVKG |
| 859 | anti-huCCR8_44379(VH:D61S, VL:N67Q_M99G_W109F_S111A)_huIgG1z (mAb)_HC huCCR8 HV hv_cdr3 | VYYGSGTYYKNRYYYGMDV |
| 860 | anti-huCCR8_44379(VH:D61S, VL:N67Q_M99G_W109F_S111A)_huIgG1z (mAb)_LC huCCR8 LV lv_cdr1 | GGHNIGSKGVH |
| 861 | anti-huCCR8_44379(VH:D61S, VL:N67Q_M99G_W109F_S111A)_huIgG1z (mAb)_LC huCCR8 LV lv_cdr2 | RQSNRPS |
| 862 | anti-huCCR8_44379(VH:D61S, VL:N67Q_M99G_W109F_S111A)_huIgG1z (mAb)_LC huCCR8 LV lv_cdr3 | QAFDAGTVV |
| 863 | Hu anti-huCCR8 LIBC315615-1 HuIgG1z mAb_LC huCCR8 LV lv_cdr1 | GGHNIGSKGVH |
| 864 | Hu anti-huCCR8 LIBC315615-1 HuIgG1z mAb_LC huCCR8 LV lv_cdr2 | RNSNRPS |
| 865 | Hu anti-huCCR8 LIBC315615-1 HuIgG1z mAb_LC huCCR8 LV lv_cdr3 | QVWDISTVV |
| 866 | Hu anti-huCCR8 LIBC315615-1 HuIgG1z mAb_HC huCCR8 HV hv_cdr1 | NCGMH |
| 867 | Hu anti-huCCR8 LIBC315615-1 HuIgG1z mAb_HC huCCR8 HV hv_cdr2 | VISYDGGNKYHADSVKG |
| 868 | Hu anti-huCCR8 LIBC315615-1 HuIgG1z mAb_HC huCCR8 HV hv_cdr3 | VYYGSGIYYKNRYYYGMDV |
| 869 | Hu anti-huCCR8 LIBC317152-1 HuIgG1z mAb_LC huCCR8 LV lv_cdr1 | GGHNIGSKGVH |
| 870 | Hu anti-huCCR8 LIBC317152-1 HuIgG1z mAb_LC huCCR8 LV lv_cdr2 | RNSNRPS |

TABLE 20-continued

Amino acid sequences.

| SEQ ID NO: | Designation | Sequence |
|---|---|---|
| 871 | Hu anti-huCCR8 LIBC317152-1 HuIgG1z mAb_LC huCCR8 LV lv_cdr3 | QVWDSSTVV |
| 872 | Hu anti-huCCR8 LIBC317152-1 HuIgG1z mAb_HC huCCR8 HV hv_cdr1 | NCGMH |
| 873 | Hu anti-huCCR8 LIBC317152-1 HuIgG1z mAb_HC huCCR8 HV hv_cdr2 | VISYDGGNKYYADSVKG |
| 874 | Hu anti-huCCR8 LIBC317152-1 HuIgG1z mAb_HC huCCR8 HV hv_cdr3 | VYYGSGIYYKNRYYYGMDV |
| 875 | Hu anti-huCCR8 LIBC317471-1 HuIgG1z mAb_LC huCCR8 LV lv_cdr1 | GGNNIGSKNVH |
| 876 | Hu anti-huCCR8 LIBC317471-1 HuIgG1z mAb_LC huCCR8 LV lv_cdr2 | RDSNRPS |
| 877 | Hu anti-huCCR8 LIBC317471-1 HuIgG1z mAb_LC huCCR8 LV lv_cdr3 | QVWDSNTVV |
| 878 | Hu anti-huCCR8 LIBC317471-1 HuIgG1z mAb_HC huCCR8 HV hv_cdr1 | NNGMH |
| 879 | Hu anti-huCCR8 LIBC317471-1 HuIgG1z mAb_HC huCCR8 HV hv_cdr2 | VISNDGSNKYYADSVRG |
| 880 | Hu anti-huCCR8 LIBC317471-1 HuIgG1z mAb_HC huCCR8 HV hv_cdr3 | VYYGSGIYYKNNYYYGMDV |
| 881 | Hu anti-huCCR8 LIBC317977-1 HuIgG1z mAb_LC huCCR8 LV lv_cdr1 | GGNNIGSKNVH |
| 882 | Hu anti-huCCR8 LIBC317977-1 HuIgG1z mAb_LC huCCR8 LV lv_cdr2 | RNSNRPS |
| 883 | Hu anti-huCCR8 LIBC317977-1 HuIgG1z mAb_LC huCCR8 LV lv_cdr3 | QVWDSSTVV |
| 884 | Hu anti-huCCR8 LIBC317977-1 HuIgG1z mAb_HC huCCR8 HV hv_cdr1 | TYGMH |
| 885 | Hu anti-huCCR8 LIBC317977-1 HuIgG1z mAb_HC huCCR8 HV hv_cdr2 | VISYDGSNKYYADSVKG |
| 886 | Hu anti-huCCR8 LIBC317977-1 HuIgG1z mAb_HC huCCR8 HV hv_cdr3 | VYYGSGSYYKKNYYYGMDV |
| 887 | Hu anti-huCCR8 LIBC318774-1 HuIgG1z mAb_LC huCCR8 LV lv_cdr1 | GGNNIGGKNVH |
| 888 | Hu anti-huCCR8 LIBC318774-1 HuIgG1z mAb_LC huCCR8 LV lv_cdr2 | RDSNRPS |
| 889 | Hu anti-huCCR8 LIBC318774-1 HuIgG1z mAb_LC huCCR8 LV lv_cdr3 | QVWDSSTVV |
| 890 | Hu anti-huCCR8 LIBC318774-1 HuIgG1z mAb_HC huCCR8 HV hv_cdr1 | SYGFH |
| 891 | Hu anti-huCCR8 LIBC318774-1 HuIgG1z mAb_HC huCCR8 HV hv_cdr2 | VISYDGSNKYYADSVKG |
| 892 | Hu anti-huCCR8 LIBC318774-1 HuIgG1z mAb_HC huCCR8 HV hv_cdr3 | VYYGSGTYYKNRYYYGMDV |
| 893 | Hu anti-huCCR8 LIBC319840-1 HuIgG1z mAh_LC huCCR8 LV lv_cdr1 | GGNNIGSKNVH |
| 894 | Hu anti-huCCR8 LIBC319840-1 HuIgG1z mAb_LC huCCR8 LV lv_cdr2 | RDSNRPS |
| 895 | Hu anti-huCCR8 LIBC319840-1 HuIgG1z mAb_LC huCCR8 LV lv_cdr3 | QVWDSSTVV |

TABLE 20-continued

Amino acid sequences.

| SEQ ID NO: | Designation | Sequence |
|---|---|---|
| 896 | Hu anti-huCCR8 LIBC319840-1 HuIgG1z mAb_HC huCCR8 HV hv_cdr1 | NNGMH |
| 897 | Hu anti-huCCR8 LIBC319840-1 HuIgG1z mAb_HC huCCR8 HV hv_cdr2 | VISNDGSNKYYPDSVKG |
| 898 | Hu anti-huCCR8 LIBC319840-1 HuIgG1z mAb_HC huCCR8 HV hv_cdr3 | VYYGSGNYYKNNYYYGMDV |
| 899 | Hu anti-huCCR8 LIBC320212-1 HuIgG1z mAb_LC huCCR8 LV lv_cdr1 | EGNNIGSQNVH |
| 900 | Hu anti-huCCR8 LIBC320212-1 HuIgG1z mAb_LC huCCR8 LV lv_cdr2 | RDSNRPS |
| 901 | Hu anti-huCCR8 LIBC320212-1 HuIgG1z mAb_LC huCCR8 LV lv_cdr3 | QVWDGSAVV |
| 902 | Hu anti-huCCR8 LIBC320212-1 HuIgG1z mAb_HC huCCR8 HV hv_cdr1 | SSGMH |
| 903 | Hu anti-huCCR8 LIBC320212-1 HuIgG1z mAb_HC huCCR8 HV hv_cdr2 | VISHDGSNKYYADSVKG |
| 904 | Hu anti-huCCR8 LIBC320212-1 HuIgG1z mAb_HC huCCR8 HV hv_cdr3 | VYYGSGIYYKNRYYYGMDV |
| 905 | Hu anti-huCCR8 LIBC320384-1 HuIgG1z mAb_LC huCCR8 LV lv_cdr1 | GGHNIGSKGVH |
| 906 | Hu anti-huCCR8 LIBC320384-1 HuIgG1z mAb_LC huCCR8 LV lv_cdr2 | RNSNRPS |
| 907 | Hu anti-huCCR8 LIBC320384-1 HuIgG1z mAb_LC huCCR8 LV lv_cdr3 | QVWDSSTVV |
| 908 | Hu anti-huCCR8 LIBC320384-1 HuIgG1z mAb_HC huCCR8 HV hv_cdr1 | DCGMH |
| 909 | Hu anti-huCCR8 LIBC320384-1 HuIgG1z mAb_HC huCCR8 HV hv_cdr2 | VISYDGGNKYYADSVKG |
| 910 | Hu anti-huCCR8 LIBC320384-1 HuIgG1z mAb_HC huCCR8 HV hv_cdr3 | VYYGSGIYYKNRYYYGMDV |
| 911 | Hu anti-huCCR8 LIBC320689-1 HuIgG1z mAb_LC huCCR8 LV lv_cdr1 | GGNNIGSKNVH |
| 912 | Hu anti-huCCR8 LIBC320689-1 HuIgG1z mAb_LC huCCR8 LV lv_cdr2 | RSSNRPS |
| 913 | Hu anti-huCCR8 LIBC320689-1 HuIgG1z mAb_LC huCCR8 LV lv_cdr3 | QIWDSSTVV |
| 914 | Hu anti-huCCR8 LIBC320689-1 HuIgG1z mAb_HC huCCR8 HV hv_cdr1 | SYGMH |
| 915 | Hu anti-huCCR8 LIBC320689-1 HuIgG1z mAb_HC huCCR8 HV hv_cdr2 | VISFDGNNKYYADSVKG |
| 916 | Hu anti-huCCR8 LIBC320689-1 HuIgG1z mAb_HC huCCR8 HV hv_cdr3 | VYYGSGSYYKNRYYYGMDV |
| 917 | Hu anti-huCCR8 LIBC321408-1 HuIgG1z mAb_LC huCCR8 LV lv_cdr1 | GGNNIGSKNVH |
| 918 | Hu anti-huCCR8 LIBC321408-1 HuIgG1z mAb_LC huCCR8 LV lv_cdr2 | RDSNRPS |
| 919 | Hu anti-huCCR8 LIBC321408-1 HuIgG1z mAb_LC huCCR8 LV lv_cdr3 | QVWDSSTVV |
| 920 | Hu anti-huCCR8 LIBC321408-1 HuIgG1z mAb_HC huCCR8 HV hv_cdr1 | SNGMH |

TABLE 20-continued

Amino acid sequences.

| SEQ ID NO: | Designation | Sequence |
|---|---|---|
| 921 | Hu anti-huCCR8 LIBC321408-1 HuIgG1z mAb_HC huCCR8 HV hv_cdr2 | VISNDGSNKYYGDSVKG |
| 922 | Hu anti-huCCR8 LIBC321408-1 HuIgG1z mAb_HC huCCR8 HV hv_cdr3 | VYYGSGIYYRNNYYYGMDV |
| 923 | Hu anti-huCCR8 LIBC321824-1 HuIgG1z mAb_LC huCCR8 LV lv_cdr1 | GGNNIGSKNVH |
| 924 | Hu anti-huCCR8 LIBC321824-1 HuIgG1z mAb_LC huCCR8 LV lv_cdr2 | RNTNRPS |
| 925 | Hu anti-huCCR8 LIBC321824-1 HuIgG1z mAb_LC huCCR8 LV lv_cdr3 | QVWDSSTVV |
| 926 | Hu anti-huCCR8 LIBC321824-1 HuIgG1z mAb_HC huCCR8 HV hv_cdr1 | GYGMH |
| 927 | Hu anti-huCCR8 LIBC321824-1 HuIgG1z mAb_HC huCCR8 HV hv_cdr2 | VISYDGSNKYYADSVKG |
| 928 | Hu anti-huCCR8 LIBC321824-1 HuIgG1z mAb_HC huCCR8 HV hv_cdr3 | VYYGSGIYYKNRYYYGMDV |
| 929 | Hu anti-huCCR8 LIBC321845-1 HuIgG1z mAb_LC huCCR8 LV lv_cdr1 | GGNNIGSKNVH |
| 930 | Hu anti-huCCR8 LIBC321845-1 HuIgG1z mAb_LC huCCR8 LV lv_cdr2 | RNTNRPS |
| 931 | Hu anti-huCCR8 LIBC321845-1 HuIgG1z mAb_LC huCCR8 LV lv_cdr3 | QVWDSSTVV |
| 932 | Hu anti-huCCR8 LIBC321845-1 HuIgG1z mAb_HC huCCR8 HV hv_cdr1 | GYGMH |
| 933 | Hu anti-huCCR8 LIBC321845-1 HuIgG1z mAb_HC huCCR8 HV hv_cdr2 | VISYDGSNKYYADSVKG |
| 934 | Hu anti-huCCR8 LIBC321845-1 HuIgG1z mAb_HC huCCR8 HV hv_cdr3 | VYYGSGIYYKNRYYYGMDV |
| 935 | Hu anti-huCCR8 LIBC322176-1 HuIgG1z mAb_LC huCCR8 LV lv_cdr1 | GGNNIGDKNVH |
| 936 | Hu anti-huCCR8 LIBC322176-1 HuIgG1z mAb_LC huCCR8 LV lv_cdr2 | RNNVRPS |
| 937 | Hu anti-huCCR8 LIBC322176-1 HuIgG1z mAb_LC huCCR8 LV lv_cdr3 | QVWDSSTVV |
| 938 | Hu anti-huCCR8 LIBC322176-1 HuIgG1z mAb_HC huCCR8 HV hv_cdr1 | NFGMH |
| 939 | Hu anti-huCCR8 LIBC322176-1 HuIgG1z mAb_HC huCCR8 HV hv_cdr2 | VISYDGGNKYYADSVKG |
| 940 | Hu anti-huCCR8 LIBC322176-1 HuIgG1z mAb_HC huCCR8 HV hv_cdr3 | VYYGSGSYYKKRYYYGMDV |
| 941 | Hu anti-huCCR8 LIBC323412-1 HuIgG1z mAb_LC huCCR8 LV lv_cdr1 | GGNNIGSKNVH |
| 942 | Hu anti-huCCR8 LIBC323412-1 HuIgG1z mAb_LC huCCR8 LV lv_cdr2 | RDSNRPS |
| 943 | Hu anti-huCCR8 LIBC323412-1 HuIgG1z mAb_LC huCCR8 LV lv_cdr3 | QVWDSSTVV |
| 944 | Hu anti-huCCR8 LIBC323412-1 HuIgG1z mAb_HC huCCR8 HV hv_cdr1 | SCGMH |
| 945 | Hu anti-huCCR8 LIBC323412-1 HuIgG1z mAb_HC huCCR8 HV hv_cdr2 | VISYDGTNKYYADSVKG |

TABLE 20-continued

Amino acid sequences.

| SEQ ID NO: | Designation | Sequence |
|---|---|---|
| 946 | Hu anti-huCCR8 LIBC323412-1 HuIgG1z mAb_HC huCCR8 HV hv_cdr3 | VYYGSIYYKKNYYYGMDV |
| 947 | huCCR8_32360_huIgG1z mAb_HC huCCR8 HV hv_cdr1 | NARMG |
| 948 | huCCR8_32360_huIgG1z mAb_HC huCCR8 HV hv_cdr2 | RIKSKTEGGTRDYAAPVKG |
| 949 | huCCR8_32360_huIgG1z mAb_HC huCCR8 HV hv_cdr3 | YSGV |
| 950 | huCCR8_32360_huIgG1z mAb_LC huCCR8 LV lv_cdr1 | KSSQSVLYSSNNKNYLA |
| 951 | huCCR8_32360_huIgG1z mAb_LC huCCR8 LV lv_cdr2 | WASTRES |
| 952 | huCCR8_32360_huIgG1z mAb_LC huCCR8 LV lv_cdr3 | QQYYSIPIT |
| 953 | MPK20298-A4_SCFV HV huCCR8 | QVQLVESGGGVVQPGRSLRLSCVVSGFNFSNNGMHWVRQAPGKGLEWVAVISNDGSNKYYADSVKGRFTISRDNSKNTLYLQMNSLRTEDTAVYYCAKVYYGSGIYYKNRNYYGMDVWGQGTTVTVSS |
| 954 | MPK20298-A4_SCFV LV huCCR8 | SYELTQPPSVSVALGQTARITCGGNNIGSQNVHWYQQKPGQAPVLVIYRDSNRPSGIPDRFSGSKSGNTATLTISRAQAGDEADYYCQVWDSSTVVFGGGTKLTVL |
| 955 | MPK20299-D2_SCFV HV huCCR8 | QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSS |
| 956 | MPK20299-D2_SCFV LV huCCR8 | SYELTQPPSVSVALGQTARITCGGHNIGSKGVHWYQQKPGQAPVLVIYRNSNRPSGIPERFSGSNSGNTATLTITRAQAGDEADYYCQVWDSSTVVFGGGTKLTVL |
| 957 | MPK20299-F11_SCFV HV huCCR8 | QVQLVESGGGVVQPGRSLRLSCAPSGFNFSNYGMHWVRQAPGKGLEWVAVISYDGSNKYYADSVKGRFTISRDNSKNTLFLQMNSLRAEDTAVYFCARVYYGSGSYYKKRYYYGMDVWGQGTTVTVSS |
| 958 | MPK20299-F11_SCFV LV huCCR8 | SYELTQPPSVSVALGQTARITCGGNNIGSQNVHWYQQKPGQAPVLVIYRDSNRPSGIPERFSGSKSGNTATLTISRAQAGDEADYYCQVWDSSTVVFGGGTQLTVL |
| 959 | MPK20298-H6_SCFV HV huCCR8 | QVQLVESGGGVVQPGRSLRLSCAASGFTFSSSGMHWVRQAPGKGLEWVAVISYDGTNKYYADSVKGRFTISRDNSKNTLYLQMNSLRAEDTAVYYCAKVYYGSGIYYKNRYYYGMDVWGQGTTVTVSS |
| 960 | MPK20298-H6_SCFV LV huCCR8 | SYELTQPPSVSVALGQTARITCGGHNIGSKGVHWYQQKPGQAPVLVIYRNSNRPSGIPERFSGSNSGNTATLTISRAQAGDEADYYCQVWDSSTVVFGGGTQLTVL |
| 961 | MPK20297-A4_SCFV HV huCCR8 | QVQLVESGGGVVQPGRSLRLSCAVSGFNFSNYGMHWVRQVPGRGLDWVA |

TABLE 20-continued

Amino acid sequences.

| SEQ ID NO: | Designation | Sequence |
|---|---|---|
| | | VISNDGSNKYYADSVKGRFTISRDNS KNTLYLQMDSLRTEDTAVYYCAKV YYGSGIYYKKRYYYGMDVWGQGTT VTVSS |
| 962 | MPK20297-A4_SCFV LV huCCR8 | SYELTQPPSVSVALGQTARITCGGHN IGSQNVHWYQQKPGQAPVLVIYRDS NRPSGIPERFSGSKSGNTATLTISRAQ AGDEADYYCQVWDSSTVVFGGGTQ LTVL |
| 963 | MPK20299-H8_SCFV HV huCCR8 | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSS |
| 964 | MPK20299-H8_SCFV LV huCCR8 | SYELTQPPSVSVAPGQTARITCGGNNI GSKNVHWYQQKAGQAPVQVIYRNS NRPSGIPARFSGSNSGNTATLTISRAQ AGDEADYYCQVWDSSTVVFGGGTK LTVL |
| 965 | MPK20300-C11_SCFV HV huCCR8 | QVQLVESGGGVVQPGRSLRLSCAAS GFTFSSYGMHWVRQAPGKGLEWVA VISYDGSNKYYADSVKGRFTISRDNS KNTLYLQMNSLRGEDTAVYYCARV YYGSGSYYKNRYYYGMDVWGQGT TVTVSS |
| 966 | MPK20300-C11_SCFV LV huCCR8 | SYELTQPPSVSVAPGQTARIPCGGNNI GSKNVHWYQQKPGQAPVLVIYRDIN RPSGIPERFSGSNSGNTATLTISRAQA GDEADYYCQVWDSSVVFGGGTKLT VL |
| 967 | MPK20298-B1_SCFV HV huCCR8 | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSS |
| 968 | MPK20298-B1_SCFV LV huCCR8 | SYELTQPPSVSVALGQTARLTCEGNN IGSKNVHWYQQKPGQAPVLVIYRNS NRPSGIPERFSGSNSGNTATLTISRVQ AGDEADYYCQAWDSSTVVFGGGTQ LTVL |
| 969 | MPK20297-E5_SCFV HV huCCR8 | QVQLVESGGGLVKPGGSLRLSCAVS GFNFSNNGMHWVRQAPGKGLEWVA VISYDGSNKYYTDSVKGRFTISRDNS KNTLYLQMNSLRTEDTAVYYCAKV YYGSGIYYKKRYYYGMDVWGQGTT VTVSS |
| 970 | MPK20297-E5_SCFV LV huCCR8 | SYELTQPLSVSEALGQTARITCGGNNI GSKNVHWYQQKPGQAPVLVIYRDSN RPSGIPERFSGSNSGNAATLTISRVEA GDEADYYCQVWDSSSDHVVFGGGT QLTVL |
| 971 | MPK20299-A3_SCFV HV huCCR8 | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSS |
| 972 | MPK20299-A3_SCFV LV huCCR8 | SYELTQPPSVSVAPGQTARITCGGNNI GSKNVHWYQQKPGQAPVLVIYRNSN RPSGIPERFSGSNSGNTATLTISGTQA MDEADYYCQAWDSSNVVFGGGTQL TVL |

TABLE 20-continued

Amino acid sequences.

| SEQ ID NO: | Designation | Sequence |
|---|---|---|
| 973 | MPK20297-B4_SCFV HV huCCR8 | QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSS |
| 974 | MPK20297-B4_SCFV LV huCCR8 | SYELTQPLSVSVALGQTARITCGGNNIGSQNVHWYQQKPGQAPVLVIYRDSNRPSGIPDRFSGSKSGNTATLTISRAQAGDEADYYCQVWDSSTVVFGGGTQLTVL |
| 975 | MPK20298-F6_SCFV HV huCCR8 | QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNRYYYGMDVWGQGTTVTVSS |
| 976 | MPK20298-F6_SCFV LV huCCR8 | SYELTQPPSVSVAPGQTARITCGGNNIGSKNVHWYQQKPGQAPVLVIYRDSNRPSGIPERFSGSKSGTTATLTISRAQAGDEAEYYCQVWDSSTVVFGGGTELTVL |
| 977 | MPK20299-H3_SCFV HV huCCR8 | QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSS |
| 978 | MPK20299-H3_SCFV LV huCCR8 | SYELTQPLSVSVALGQTARITCGGNNIGSKNVHWYQQKPGQAPVLAIYRNSNRPSGIPERFTGSNSGNTATLTISRAQAGDESDYYCQIWDSSTVVFGGGTKLTVL |
| 979 | MPK20298-B9_SCFV HV huCCR8 | QVQLVESGGGVVQPGRSLRLSCAASGFNFSRNGMHWVRQVPGRGLDWVAVISNDGSNKYYADSVKGRFTISRDNSKNTLYLQMNSLRAEDTAVYYCAKVYYGSGIYYKKNYYYGMDVWGQGTTVTVSS |
| 980 | MPK20298-B9_SCFV LV huCCR8 | SYELTQPPSVSVALGQTARISCGGNNIGSKNVHWYQQKPGQAPVLVIYRDSNRPSGIPERFSGSKSGTTATLTISRAQAGDEAEYYCQVWDSSTVVFGGGTQLTVL |
| 981 | MPK20299-E2_SCFV HV huCCR8 | QVQLVESGGGVVQPGRSLRLSCAVSGFNFSNNGMHWVRQAPGKGLEWVAVISYDGSNKYYTDSVKGRFTISRDNSKNTLYLQMNSLRTEDTAVYYCAKVYYGSGIYYKKRYYYGMDVWGQGTTVTVSS |
| 982 | MPK20299-E2_SCFV LV huCCR8 | SYELTQPPSVSVALGQTARITCEGNNIGSQNVHWYQQKPGQAPVLVMYRDSNRPSGIPERFSGSKSGNTATLAISRAQAGDESDYYCQVWDGSAVVFGGGTKLTVL |
| 983 | MPK20299-D6_SCFV HV huCCR8 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSS |
| 984 | MPK20299-D6_SCFV LV huCCR8 | SYELTQPLSVSVALGQTARITCEGNNIGSQNVHWYQQKPGQAPVLVMYRDS |

TABLE 20-continued

Amino acid sequences.

| SEQ ID NO: | Designation | Sequence |
|---|---|---|
| | | NRPSGIPERFSGSKSGNTATLAISRAQ AGDESDYYCQVWDGSAVVFGGGTQ LTVL |
| 985 | MPK20299-A4_SCFV HV huCCR8 | QVQLVESGGGVVQPGRSLRLSCAAS GFTFSNYGFHWVRQTPGKGLEWVA VISYDGSNRYYADSVKGRFTISRDNS KNTLYLQMNSLRGEDTALYYCARV YYGSGTYYKNRYYYGMDVWGQGT TVTVSS |
| 986 | MPK20299-A4_SCFV LV huCCR8 | SYELTQPPSVSVALGQTARITCGGHN IGSKGVHWYQQKPGQAPVLVIYRNS NRPSGIPERFSGSNSGNTATLTISGTQ AMDEADYYCQAWDSGTVVFGGGTQ LTVL |
| 987 | MPK20300-G5_SCFV HV huCCR8 | QVQLVESGGGVVQPGRSLRLSCAAS GFTFSNYGFHWVRQTPGKGLEWVA VISYDGSNRYYADSVKGRFTISRDNS KNTLYLQMNSLRGEDTALYYCARV YYGSGTYYKNRYYYGMDVWGQGT TVTVSS |
| 988 | MPK20300-G5_SCFV LV huCCR8 | SYELTQPPSVSVALGQTARITCGANN IGSKNVHWYQQKPGQPPVLVIYRDF NRPSGIPERFSASNSGNTATLTISRGQ AGDEADYYCQVWDSSTGNVVFGGG TKLTVL |
| 989 | MPK20299-C3_SCFV HV huCCR8 | QVQLVESGGGVVQPGRSLRLSCAAS GFIFSNYGFHWVRQTPGKGLEWVAV ISYDGSNKYYADSVKGRFTISRDNSK NTLYLQMNSLRGEDTAVYYCARVY YGSGSYYKNRYYYGMDVWGQGTT VTVSS |
| 990 | MPK20299-C3_SCFV LV huCCR8 | SYELTQPPSVSVAPGQTARITCGGNNI GSKNVHWYQQKPGQAPVLVIYRDSN RPSGIPERFSGSKSGTTATLTISRAQA GDEADYYCQVWDSSTVVFGGGTELT VL |
| 991 | MPK20299-B7_SCFV HV huCCR8 | QVQLVESGGGVVQPGRSLRLSCAAS GFNFSNYGMHWVRQAPGKGLEWVA VISYDGSNRYYADSVKGRFTISRDNS KNTLYLQMNSLRAEDTAVYFCARVY YGSGIYYKKRYYYGMDVWGQGTTV TVSS |
| 992 | MPK20299-B7_SCFV LV huCCR8 | SYELTQSSSVSVAPGQTARITCGGNNI GSKNVHWYQQKPGQAPVLVIYRDSN RPSGIPERFSGSKSGTTATLTISRVEA GDEADYYCQVWDSSSAHVIFGGGTK LTVL |
| 993 | MPK20299-A5_SCFV HV huCCR8 | QVQLVESGGGVVQPGRSLRLSCGAS GFTFSGYGMHWVRQAPGKGLEWVA VISYDGSNRYYADSVKGRFTISRDNS KNTLYLQMNSLRGEDTAVYYCARV YYGSGIYYKNRYYYGMDVWGQGTT VTVSS |
| 994 | MPK20299-A5_SCFV LV huCCR8 | SYELTQPPSGSVALGQTARITCGGNN LGSKNVHWYQQKPGQAPVLVIYRNS NRPSGIPERFSGSNSGNTATLTISRAQ AGDEADYYCQVWDSSTVVFGGGTK LTVL |
| 995 | MPK20299-D1_SCFV HV huCCR8 | QVQLVESGGGLVKPGGSLRLSCAAS GFTFSNNGMHWVRQAPGKGLEWVA VISYDGSNKYYADSVKGRFTISRDNS KNTLYLQMNSLRAEDTAVYYCAKV YYGSGIYYKNRYYYGMDVWGQGTT VTVSS |

TABLE 20-continued

Amino acid sequences.

| SEQ ID NO: | Designation | Sequence |
|---|---|---|
| 996 | MPK20299-D1_SCFV LV huCCR8 | SYELTQPPSVSVALGQTARITCGGNRI GSKNVHWYQQKPGQAPVLVIYRDSN RPSGIPERFSGSKSGTTATLTISRAQA GDEAEYYCQVWDSSTVVFGGGTKLT VL |
| 997 | MPK20299-C5_SCFV HV huCCR8 | QVQLVESGGGVVQPGRSLRLSCAAS GFTFSNYGFHWVRQTPGKGLEWVA VISYDGSNRYYADSVKGRFTISRDNS KNTLYLQMNSLRGEDTALYYCARV YYGSGTYYKNRYYYGMDVWGQGT TVTVSS |
| 998 | MPK20299-C5_SCFV LV huCCR8 | SYELTQLPSVSVALGQTARITCGGHN IGSKGVHWYQQKPGQAPVLVIYRNS NRPSGIPERFSGSNSGNTATLTISRAQ AGDEADYYCQVWDSSTVVFGGGTE LTVL |
| 999 | MPK20299-B5_SCFV HV huCCR8 | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKNRYYYGMDVWGQTTV TVSS |
| 1000 | MPK20299-B5_SCFV LV huCCR8 | SYELTQPPSVSVALGQTARITCGGHN IGSKGVHWYQQKPGQAPVLVIYRNS NRPSGIPERFSGSNSGNTATLTISRAQ AGDEADYYCQVWDSSTVVFGGGTQ LTVL |
| 1001 | MPK20299-G9_SCFV HV huCCR8 | QVQLVESGGDLVQPGRSLRLSCAAS GFTFSNNGMHWVRQAPGKGLEWVA VISNDGSNKYYADSVRGRFTISRDNS KNTLYLQMNSLRAEDTAVYYCAKV YYGSGIYYKNRYYYGMDVWGQGTT VTVSS |
| 1002 | MPK20299-G9_SCFV LV huCCR8 | SYELTQPLSVSVALGQTARITCGGNN IGSKNVHWYQQKPGQAPVLVIYRNS NRPSGIPERFSGSNSGNTATLTLSRVQ AGDEADYYCQVWDSSTVVFGGGTK LTVL |
| 1003 | MPK20299-G5_SCFV HV huCCR8 | QVQLVESGGGVVQPGRSLRLSCAVS GFNFSNNGMHWVRQAPGKGLEWVA VISNDGSNKYYADSVRGRFTISRDNS KNTLYLQMDSLRTEDTAVYYCAKV YYGSGIYYKNRYYYGMDVWGQGTT VTVSS |
| 1004 | MPK20299-G5_SCFV LV huCCR8 | SYELTQPPSVSVALGQTARLTCEGNN IGSKNVHWYQQKPGQAPVLVIYRDS NRPSGIPERFSGSKSGNTATLAISRAQ AGDESDYYCQVWDSSAVVFGGGTK LTVL |
| 1005 | MPK20298-C10_SCFV HV huCCR8 | QVQLVESGGGVVQPGRSLRLSCAAS GFTFSSSGMHWVRQAPGKGLEWVA VISNDGSNKYYADSVKGRFTISRDNS KNTLYLQMNSLRAEDTAVYYCAKV YYGSGIYYKNNYYYGMDVWGQGTT VTVSS |
| 1006 | MPK20298-C10_SCFV LV huCCR8 | SYELTQPPSVSVALGQTARITCGGNN IGSKNVHWYQQKPGQAPVLAIYRNS NRPSGIPERFTGSNSGNTATLTISGTQ AMDEADYYCQAWDSSTVVFGGGTK LTVL |
| 1007 | MPK20298-B5_SCFV HV huCCR8 | QVQLVESGGGVVQPGRSLRLSCAAS GFNFSNYGMHWVRQAPGKGLEWVA VISYDGSNKYYADSVKGRFTISRDNS |

TABLE 20-continued

Amino acid sequences.

| SEQ ID NO: | Designation | Sequence |
|---|---|---|
| | | KNTLYLQMNSLRAEDTAVYFCARVYYGSGIYYKKRYYYGMDVWGQGTTVTVSS |
| 1008 | MPK20298-B5_SCFV LV huCCR8 | SYELTQPPSVSVALGQTARITCGGNNIGSQNVHWYQQKPGQAPVLVIYRDSNRPSGIPERFSGSKSGNTATLAISRAQAGDESDYYCQVWDSSAVVFGGGTQLTVL |
| 1009 | MPK20299-F2_SCFV HV huCCR8 | QVQLVESGGGVVQPGRSLRLSCAASGFTLSSSGMHWVRQAPGKGLEWVAVISNDGSNKYYADSVKGRFTISRDDSKNTLYLQMDSLRTEDTAVYYCAKVYYGSGIYYKNRYYYGMDVWGQGTTVTVSS |
| 1010 | MPK20299-F2_SCFV LV huCCR8 | SYELTQPPSVSVALGQTARISCGGNNIGSKNVHWYQQKPGQAPVLVMYRDSNRPSGIPERFSGSNSGNTATLTISGTQAMDEADYYCQAWDSGTVVFGGGTKLTVL |
| 1011 | MPK20298-D4_SCFV HV huCCR8 | QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSS |
| 1012 | MPK20298-D4_SCFV LV huCCR8 | SYELTQPPSVSVALGQTARITCGGNNIGGKNVHWYQQKPGQAPVLVIYRDSNRPSGIPERFSGSKSGNTATLTISRAQAGDESDYYCQVWDSSTVVFGGGTQLTVL |
| 1013 | MPK20297-F5_SCFV HV huCCR8 | QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSS |
| 1014 | MPK20297-F5_SCFV LV huCCR8 | SYELTQPLSVSVALGQTARITCGGNNIGSKNVHWYQQKPGQAPVLVIYRNSNRPSGIPERFSGSNSGNTATLTISRAQAGDEADYYCQVWDSSTVVFGGGTKLTVL |
| 1015 | MPK20299-D9_SCFV HV huCCR8 | QVQLVESGGGLVKPGGSLRLSCAASGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSS |
| 1016 | MPK20299-D9_SCFV LV huCCR8 | SYELTQPPSVSVALGQTARISCGGNNIESKNVHWYQQKPGQAPVLVIYRDSNRPSGIPERFSGSKSGTTATLTISRAQAGDEAEYYCQVWDSSTVVFGGGTQLTVL |
| 1017 | huCCR8_32360_huIgG1z mAb(LC:K38R)_HC HV huCCR8 | EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSS |
| 1018 | huCCR8_32360_huIgG1z mAb(LC:K38R)_LC LV huCCR8 | DIVMTQSPDSLAVSLGERATINCKSSQSVLYSSNNRNYLAWHQKPGQSPKLLISWASTRESGVPDRFSGSGSGTDFTLTINSLQAEDVAVYYCQQYYSIPITFGGGTKVEIKR |

TABLE 20-continued

Amino acid sequences.

| SEQ ID NO: | Designation | Sequence |
|---|---|---|
| 1019 | anti-huCCR8_44379(VH:D72S, VL:N67A_S68A_M99G_W109F_S111A)_huIgG1z (mAb)_HC HV huCCR8 | QVQLVESGGGVVQPGRSLRLSCAAS GFTFSNYGFHWVRQTPGKGLEWVA VISYDGSNRYYASSVKGRFTISRDNS KNTLYLQMNSLRGEDTALYYCARV YYGSGTYYKNRYYYGMDVWGQGT TVTVSS |
| 1020 | anti-huCCR8_44379(VH:D72S, VL:N67A_S68A_M99G_W109F_S111A)_huIgG1z (mAb)_LC LV huCCR8 | SYELTQPPSVSVALGQTARITCGGHN IGSKGVHWYQQKPGQAPVLVIYRAA NRPSGIPERFSGSNSGNTATLTISGTQ AGDEADYYCQAFDAGTVVFGGGTQ LTVLG |
| 1021 | anti-huCCR8_44379(VH:D61A_D72A, VL:N67Q_M99E_W109F_S111A)_huIgG1z (mAb)_HC HV huCCR8 | QVQLVESGGGVVQPGRSLRLSCAAS GFTFSNYGFHWVRQTPGKGLEWVA VISYAGSNRYYAASVKGRFTISRDNS KNTLYLQMNSLRGEDTALYYCARV YYGSGTYYKNRYYYGMDVWGQGT TVTVSS |
| 1022 | anti-huCCR8_44379(VH:D61A_D72A, VL:N67Q_M99E_W109F_S111A)_huIgG1z (mAb)_LC LV huCCR8 | SYELTQPPSVSVALGQTARITCGGHN IGSKGVHWYQQKPGQAPVLVIYRQS NRPSGIPERFSGSNSGNTATLTISGTQ AEDEADYYCQAFDAGTVVFGGGTQ LTVLG |
| 1023 | anti-huCCR8_44379(VH:D61S, VL:N67Q_M99G_W109F_S111A)_huIgG1z (mAb)_HC HV huCCR8 | QVQLVESGGGVVQPGRSLRLSCAAS GFTFSNYGFHWVRQTPGKGLEWVA VISYSGSNRYYADSVKGRFTISRDNS KNTLYLQMNSLRGEDTALYYCARV YYGSGTYYKNRYYYGMDVWGQGT TVTVSS |
| 1024 | anti-huCCR8_44379(VH:D61S, VL:N67Q_M99G_W109F_S111A)_huIgG1z (mAb)_LC LV huCCR8 | SYELTQPPSVSVALGQTARITCGGHN IGSKGVHWYQQKPGQAPVLVIYRQS NRPSGIPERFSGSNSGNTATLTISGTQ AGDEADYYCQAFDAGTVVFGGGTQ LTVLG |
| 1025 | Hu anti-huCCR8 LIBC315615-1 HuIgG1z mAb_LC LV huCCR8 | SYELTQPLSVSVALGQTARITCGGHN IGSKGVHWYQQKPGQAPVLVIYRNS NRPSGIPERFSGSNSGNTATLTISRAQ AGDEADYYCQVWDISTVVFGGGTEL TVLG |
| 1026 | Hu anti-huCCR8 LIBC315615-1 HuIgG1z mAb_HC HV huCCR8 | QVQLVESGGGVAQPGRSLRLSCAAS GFNFSNCGMHWVRQAPGKGLEWVA VISYDGGNKYHADSVKGRFTISRDDS KNTLYLQMDSLRTEDTAVYYCAKV YYGSGIYYKNRYYYGMDVWGQGTT VTVSS |
| 1027 | Hu anti-huCCR8 LIBC317152-1 HuIgG1z mAb_LC LV huCCR8 | SYELTQPLSVSVALGQTARITCGGHN IGSKGVHWYQQKPGQAPVLVIYRNS<br><br>NRPSGIPERFSGSNSGKTATLTISRAQ AGDEADYYCQVWDSSTVVFGGGTE LTVLG |
| 1028 | Hu anti-huCCR8 LIBC317152-1 HuIgG1z mAb_HC HV huCCR8 | QVQLVESGGGVAQPGRSLRLSCAAS GFNFSNCGMHWVRQAPGKGLEWVA VISYDGGNKYYADSVKGRFTISRDDS KNTLYLQMDSLRTEDTAVYYCAKV YYGSGIYYKNRYYYGMDVWGQGTT VTVSS |
| 1029 | Hu anti-huCCR8 LIBC317471-1 HuIgG1z mAb_LC LV huCCR8 | SYELTQPLSVSVALGQTARITCGGNN IGSKNVHWYQKRPGQAPVLVIYRDS NRPSGIPERFSGSKSGNTATLTISRAQ AGDEADYYCQVWDSNTVVFGGGTN LTVLG |

TABLE 20-continued

Amino acid sequences.

| SEQ ID NO: | Designation | Sequence |
|---|---|---|
| 1030 | Hu anti-huCCR8 LIBC317471-1 HuIgG1z mAb_HC HV huCCR8 | QVQLVESGGGVVQPGRSLRLSCVVS GFNFSNNGMHWVRQAPGKGLEWVA VISNDGSNKYYADSVRGRFTISRDNS KNTLYLQMNSLRAEDTAVYSCAKV YYGSGIYYKNNYYYGMDVWGQGTT VTVSS |
| 1031 | Hu anti-huCCR8 LIBC317977-1 HuIgG1z mAb_LC LV huCCR8 | SYELTQPLSVSVALGQTARITCGGNN IGSKNVHWYQQKAGQAPVQVIYRNS NRPSGIPERFSGSNSGNTATLTISRAQ AGDEADYYCQVWDSSTVVFGGGTK LTVLG |
| 1032 | Hu anti-huCCR8 LIBC317977-1 HuIgG1z mAb_HC HV huCCR8 | QVQLVESGGGVVQPGRSLRLSCAAS GFNFNTYGMHWVRQAPGKGLEWVA VISYDGSNKYYADSVKGRFTISRDNS KSTLYLQMNSLRAEDTAVYYCARVY YGSGSYYKKNYYYGMDVWGQGTT VTVSS |
| 1033 | Hu anti-huCCR8 LIBC318774-1 HuIgG1z mAb_LC LV huCCR8 | SYELTQPLSVSVALGQTARITCGGNN IGGKNVHWYQQKPGQAPVLVIYRDS NRPSGIPERFSGSKSGNTATLTISRAQ AGDESDYYCQVWDSSTVVFGGGTTL TVLG |
| 1034 | Hu anti-huCCR8 LIBC318774-1 HuIgG1z mAb_HC HV huCCR8 | QVQVVESGGGVVQPGRSLRLSCAAS GFTLSSYGFHWVRQTPGKGLEWVAV ISYDGSNKYYADSVKGRFTISRDNSK NTLYLQMNSLRGEDTAVYYCARVY YGSGTYYKNRYYYGMDVWGQGTT VTVSS |
| 1035 | Hu anti-huCCR8 LIBC319840-1 HuIgG1z mAb_LC LV huCCR8 | SYELTQPLSVSEALGQTARITCGGNNI GSKNVHWYQQKPGQAPVLVIYRDSN RPSGIPERFSGSKSGNTATLTISRAQA GDEADYYCQVWDSSTVVFGGGTKV TVLG |
| 1036 | Hu anti-huCCR8 LIBC319840-1 HuIgG1z mAb_HC HV huCCR8 | QVQLVESGGGVVQPGRSLRLSCVVS GFNFINNGMHWVRQAPGKGLDWVA VISNDGSNKYYPDSVKGRFTISRDNS KNTLYLQMNSLRAEDSAVYYCAKV YYGSGNYYKNNYYYGMDVWGQGT TVTVSS |
| 1037 | Hu anti-huCCR8 LIBC320212-1 HuIgG1z mAb_LC LV huCCR8 | SYELTQPLSVSVALGQTARITCEGNNI GSQNVHWYQQKPGQAPVLVMYRDS NRPSGIPERFSGSKSGNTATLAISRAQ AGDESDYYCQVWDGSAVVFGGGTT LTVLG |
| 1038 | Hu anti-huCCR8 LIBC320212-1 HuIgG1z mAb_HC HV huCCR8 | QMQVVESGGGVVQPGRSLRLSCAAS GFTFSSSGMHWVRQAPGKGLEWVA VISHDGSNKYYADSVKGRFTISRDNS KNTLYLQMNSLGGEDTAVYYCAKV YYGSGIYYKNRYYYGMDVWGQGTT VIVSS |
| 1039 | Hu anti-huCCR8 LIBC320384-1 HuIgG1z mAb_LC LV huCCR8 | SYELTQPLSVSVALGQTARITCGGHN IGSKGVHWYQQKPGQAPVLVIYRNS NRPSGIPERFSGSNSGNTATLTISRAQ AGDEADYYCQVWDSSTVVFGGGTE LTVLG |
| 1040 | Hu anti-huCCR8 LIBC320384-1 HuIgG1z mAb_HC HV huCCR8 | QVQLVESGGGVAQPGRSLRLSCAAS GFNFSDCGMHWVRQAPGKGLEWVA VISYDGGNKYYADSVKGRFTISRDDS KNTLYLQTDSLRTEDTAVYYCAKVY YGSGIYYKNRYYYGMDVWGQGTTV TVSS |
| 1041 | Hu anti-huCCR8 LIBC320689-1 HuIgG1z mAb_LC LV huCCR8 | SYELTQPLSVSVALGQTGRITCGGNN IGSKNVHWYQQKPGQAPVLVIYRSS |

TABLE 20-continued

Amino acid sequences.

| SEQ ID NO: | Designation | Sequence |
|---|---|---|
| | | NRPSGIPERFSGSNSGNTATLTISRAQ AGDESDYYCQIWDSSTVVFGGGTKL TVLG |
| 1042 | Hu anti-huCCR8 LIBC320689-1 HuIgG1z mAb_HC HV huCCR8 | QVQVVESGGGVVQPGRSLRLSCAAS GFTFSSYGMHWVRQAPGKGLEWVA VISFDGNNKYYADSVKGRFTISRDNS KNTLYLQMNSLRGEDTAVYYCARV YYGSGSYYKNRYYYGMDVWGQGT TVTVST |
| 1043 | Hu anti-huCCR8 LIBC321408-1 HuIgG1z mAb_LC LV huCCR8 | SYELTQPLSVSVALGQTARITCGGNN IGSKNVHWYQQRPGQAPVLVIYRDS NRPSGIPERLSGSKAGNTATLTISRAH AGDEADYYCQVWDSSTVVFGGGTE LTVQG |
| 1044 | Hu anti-huCCR8 LIBC321408-1 HuIgG1z mAb_HC HV huCCR8 | QVQLVESGGGVVQPGRSLRLSCAVS GFTFSSNGMHWVRQAPGKGLEWVA VISNDGSNKYYGDSVKGRFTISRDNS KNTLYLQMNSLRAEDTAVYYCAKV YYGSGIYYRNNYYYGMDVWGQGTT VTVSS |
| 1045 | Hu anti-huCCR8 LIBC321824-1 HuIgG1z mAb_LC LV huCCR8 | SYELTQPLSVSVALGQTARITCGGNN IGSKNVHWYQQKPGQAPILVIYRNTN RPSGIPERFSGSNSGNTATLTISRAQV GDESDYFCQVWDSSTVVFGGGTKLT VLG |
| 1046 | Hu anti-huCCR8 LIBC321824-1 HuIgG1z mAb_HC HV huCCR8 | QVQVVESGGGVVQPGRSLRLSCGAS GFTFSGYGMHWVRQAPGKGLEWVA VISYDGSNKYYADSVKGRFPISRDNS KNTLYLQMNSLRGEDTAVYYCARV YYGSGIYYKNRYYYGMDVWGQGTT VAVSS |
| 1047 | Hu anti-huCCR8 LIBC321845-1 HuIgG1z mAb_LC LV huCCR8 | SYELTQPLSVSVALGQTARITCGGNN IGSKNVHWYQQKPGQAPILVIYRNTN RPSGIPERFSGSNSGNTATLTISRAQV GDESDYFCQVWDSSTVVFGGGTKLT VLG |
| 1048 | Hu anti-huCCR8 LIBC321845-1 HuIgG1z mAb_HC HV huCCR8 | QVQVVESGGGVVQPGRSLRLSCGAS GFTFSGYGMHWVRQAPGKGLEWVA VISYDGSNKYYADSVKGRFTISRDNS KNTLYLQMNSLRGEDTAVYYCARV YYGSGIYYKNRYYYGMDVWGQGTT VAVSS |
| 1049 | Hu anti-huCCR8 LIBC322176-1 HuIgG1z mAb_LC LV huCCR8 | SYDLTQPLSVSVALGQTARITCGGNN IGDKNVHWYQQKPGQAPVLVIYRNN VRPSGIPERFSGSNSGNTATLTISRAQ AGDEADYYCQVWDSSTVVFGGGTK LTVLG |
| 1050 | Hu anti-huCCR8 LIBC322176-1 HuIgG1z mAb_HC HV huCCR8 | QVQLVESGGGVVQPGRSLRLSCAAS GLNFSNFGMHWVRQAPGKGLDWVA VISYDGGNKYYADSVKGRFTVSRDN SKNTLFLQMNSLRAEDTALYYCAKV YYGSGSYYKKRYYYGMDVWGQGT TVTVSS |
| 1051 | Hu anti-huCCR8 LIBC323412-1 HuIgG1z mAb_LC LV huCCR8 | SYELTQPLSVSVALGQTARITCGGNN IGSKNVHWYQQKPGQAPVLVIYRDS NRPSGIPERFSGSKSGNTATLTISRAQ AGDEADYYCQVWDSSTVVFGGGAK LTVLG |
| 1052 | Hu anti-huCCR8 LIBC323412-1 HuIgG1z mAb_HC HV huCCR8 | QVQLVESGGGVVQPGRSLRLSCAAS GFNFSSCGMHWVRQAPGKGLEWVA VISYDGTNKYYADSVKGRFTISRDNS KNTLYLQMNSLRAEDTAVYYCAKV YYGSGIYYKKNYYYGMDVWGQGTT VTVSS |

TABLE 20-continued

Amino acid sequences.

| SEQ ID NO: | Designation | Sequence |
|---|---|---|
| 1053 | huCCR8_32360_huIgG1z mAb_HC HV huCCR8 | EVQLVESGGGLVKPGGSLRLSCAAS GFTFSNARMGWVRQAPGKGLEWVG RIKSKTEGGTRDYAAPVKGRFTISRD DSKNTLYLQMNSLKTEDTAVYYCTS YSGVWGQGTMVTVSS |
| 1054 | huCCR8_32360_huIgG1z mAb_LC LV huCCR8 | DIVMTQSPDSLAVSLGERATINCKSS QSVLYSSNNKNYLAWYHQKPGQSPK LLISWASTRESGVPDRFSGSGSGTDFT LTINSLQAEDVAVYYCQQYYSIPITFG GGTKVEIKR |
| 1055 | huCCR8_32360_huIgG1z mAb(LC:K38R)_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1056 | huCCR8_32360_huIgG1z mAb(LC:K38R)_LC Constant | TVAAPSVFIFPPSDEQLKSGTASVVCL LNNFYPREAKVQWKVDNALQSGNS QESVTEQDSKDSTYSLSSTLTLSKAD YEKHKVYACEVTHQGLSSPVTKSFN RGEC |
| 1057 | anti-huCCR8_44379(VH:D72S, VL:N67A_S68A_M99G_W109F_S111A)_huIgG1z (mAb)_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1058 | anti-huCCR8_44379(VH:D72S, VL:N67A_S68A_M99G_W109F_S111A)_huIgG1z (mAb)_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1059 | anti-huCCR8_44379(VH:D61A_D72A, VL:N67Q_M99E_W109F_S111A)_huIgG1z (mAb)_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1060 | anti-huCCR8_44379(VH:D61A_D72A, VL:N67Q_M99E_W109F_S111A)_huIgG1z (mAb)_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |

TABLE 20-continued

Amino acid sequences.

| SEQ ID NO: | Designation | Sequence |
|---|---|---|
| 1061 | anti-huCCR8_44379(VH:D61S, VL:N67Q_M99G_W109F_S111A)_huIgG1z (mAb)_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1062 | anti-huCCR8_44379(VH:D61S, VL:N67Q_M99G_W109F_S111A)_huIgG1z (mAb)_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1063 | Hu anti-huCCR8 LIBC315615-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1064 | Hu anti-huCCR8 LIBC315615-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1065 | Hu anti-huCCR8 LIBC317152-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1066 | Hu anti-huCCR8 LIBC317152-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1067 | Hu anti-huCCR8 LIBC317471-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1068 | Hu anti-huCCR8 LIBC317471-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC |

TABLE 20-continued

Amino acid sequences.

| SEQ ID NO: | Designation | Sequence |
|---|---|---|
| | | KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1069 | Hu anti-huCCR8 LIBC317977-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1070 | Hu anti-huCCR8 LIBC317977-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1071 | Hu anti-huCCR8 LIBC318774-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1072 | Hu anti-huCCR8 LIBC318774-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1073 | Hu anti-huCCR8 LIBC319840-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1074 | Hu anti-huCCR8 LIBC319840-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1075 | Hu anti-huCCR8 LIBC320212-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1076 | Hu anti-huCCR8 LIBC320212-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT |

TABLE 20-continued

Amino acid sequences.

| SEQ ID NO: | Designation | Sequence |
|---|---|---|
| | | QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1077 | Hu anti-huCCR8 LIBC320384-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1078 | Hu anti-huCCR8 LIBC320384-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1079 | Hu anti-huCCR8 LIBC320689-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1080 | Hu anti-huCCR8 LIBC320689-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1081 | Hu anti-huCCR8 LIBC321408-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1082 | Hu anti-huCCR8 LIBC321408-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |

TABLE 20-continued

Amino acid sequences.

| SEQ ID NO: | Designation | Sequence |
|---|---|---|
| 1083 | Hu anti-huCCR8 LIBC321824-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1084 | Hu anti-huCCR8 LIBC321824-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1085 | Hu anti-huCCR8 LIBC321845-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1086 | Hu anti-huCCR8 LIBC321845-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1087 | Hu anti-huCCR8 LIBC322176-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1088 | Hu anti-huCCR8 LIBC322176-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1089 | Hu anti-huCCR8 LIBC323412-1 HuIgG1z mAb_LC Constant | QPKAAPSVTLFPPSSEELQANKATLV CLISDFYPGAVTVAWKADSSPVKAG VETTTPSKQSNNKYAASSYLSLTPEQ WKSHRSYSCQVTHEGSTVEKTVAPT ECS |
| 1090 | Hu anti-huCCR8 LIBC323412-1 HuIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC |

TABLE 20-continued

Amino acid sequences.

| SEQ ID NO: | Designation | Sequence |
|---|---|---|
| | | KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1091 | huCCR8_32360_huIgG1z mAb_HC Constant | ASTKGPSVFPLAPSSKSTSGGTAALG CLVKDYFPEPVTVSWNSGALTSGVH TFPAVLQSSGLYSLSSVVTVPSSSLGT QTYICNVNHKPSNTKVDKKVEPKSC DKTHTCPPCPAPELLGGPSVFLFPPKP KDTLMISRTPEVTCVVVDVSHEDPEV KFNWYVDGVEVHNAKTKPREEQYN STYRVVSVLTVLHQDWLNGKEYKC KVSNKALPAPIEKTISKAKGQPREPQ VYTLPPSREEMTKNQVSLTCLVKGF YPSDIAVEWESNGQPENNYKTTPPVL DSDGSFFLYSKLTVDKSRWQQGNVF SCSVMHEALHNHYTQKSLSLSPGK |
| 1092 | huCCR8_32360_huIgG1z mAb_LC Constant | TVAAPSVFIFPPSDEQLKSGTASVVCL LNNFYPREAKVQWKVDNALQSGNS QESVTEQDSKDSTYSLSSTLTLSKAD YEKHKVYACEVTHQGLSSPVTKSFN RGEC |
| 1093 | MPK20298-A4_SCFV | QVQLVESGGGVVQPGRSLRLSCVVS GFNFSNNGMHWVRQAPGKGLEWVA VISNDGSNKYYADSVKGRFTISRDNS KNTLYLQMNSLRTEDTAVYYCAKV YYGSGIYYKNRNYYGMDVWGQGTT VTVSSGGGGSGGGGSGGGGSSYELT QPPSVSVALGQTARITCGGNNIGSQN VHWYQQKPGQAPVLVIYRDSNRPSG IPDRFSGSKSGNTATLTISRAQAGDEA DYYCQVWDSSTVVFGGGTKLTVL |
| 1094 | MPK20299-D2_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PPSVSVALGQTARITCGGHNIGSKGV HWYQQKPGQAPVLVIYRNSNRPSGIP ERFSGSNSGNTATLTITRAQAGDEAD YYCQVWDSSTVVFGGGTKLTVL |
| 1095 | MPK20299-F11_SCFV | QVQLVESGGGVVQPGRSLRLSCAPS GFNFSNYGMHWVRQAPGKGLEWVA VISYDGSNKYYADSVKGRFTISRDNS KNTLFLQMNSLRAEDTAVYFCARVY YGSGSYYKKRYYYGMDVWGQGTT VTVSSGGGGSGGGGSGGGGSSYELT QPPSVSVALGQTARITCGGNNIGSQN VHWYQQKPGQAPVLVIYRDSNRPSG IPERFSGSKSGNTATLTISRAQAGDEA DYYCQVWDSSTVVFGGGTQLTVL |
| 1096 | MPK20298-H6_SCFV | QVQLVESGGGVVQPGRSLRLSCAAS GFTFSSSGMHWVRQAPGKGLEWVA VISYDGTNKYYADSVKGRFTISRDNS KNTLYLQMNSLRAEDTAVYYCAKV YYGSGIYYKNRNYYGMDVWGQGTT VTVSSGGGGSGGGGSGGGGSSYELT QPPSVSVALGQTARITCGGHNIGSKG VHWYQQKPGQAPVLVIYRNSNRPSG IPERFSGSNSGNTATLTISRAQAGDEA DYYCQVWDSSTVVFGGGTQLTVL |
| 1097 | MPK20297-A4_SCFV | QVQLVESGGGVVQPGRSLRLSCAVS GFNFSNYGMHWVRQVPGRGLDWVA VISNDGSNKYYADSVKGRFTISRDNS KNTLYLQMDSLRTEDTAVYYCAKV YYGSGIYYKKRYYYGMDVWGQGTT |

TABLE 20-continued

Amino acid sequences.

| SEQ ID NO: | Designation | Sequence |
|---|---|---|
| | | VTVSSGGGGSGGGGSGGGGSSYELT QPPSVSVALGQTARITCGGHNIGSQN VHWYQQKPGQAPVLVIYRDSNRPSG IPERFSGSKSGNTATLTISRAQAGDEA DYYCQVWDSSTVVFGGGTQLTVL |
| 1098 | MPK20299-H8_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PPSVSVAPGQTARITCGGNNIGSKNV HWYQQKAGQAPVQVIYRNSNRPSGI PARFSGSNSGNTATLTISRAQAGDEA DYYCQVWDSSTVVFGGGTKLTVL |
| 1099 | MPK20300-C11_SCFV | QVQLVESGGGVVQPGRSLRLSCAAS GFTFSSYGMHWVRQAPGKGLEWVA VISYDGSNKYYADSVKGRFTISRDNS KNTLYLQMNSLRGEDTAVYYCARV YYGSGSYYKNRYYYGMDVWGQGT TVTVSSGGGGSGGGGSGGGGSSYEL TQPPSVSVAPGQTARIPCGGNNIGSK NVHWYQQKPGQAPVLVIYRDINRPS GIPERFSGSNSGNTATLTISRAQAGDE ADYYCQVWDSSVVFGGGTKLTVL |
| 1100 | MPK20298-B1_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PPSVSVALGQTARLTCEGNNIGSKNV HWYQQKPGQAPVLVIYRNSNRPSGIP ERFSGSNSGNTATLTISRVQAGDEAD YYCQAWDSSTVVFGGGTQLTVL |
| 1101 | MPK20297-E5_SCFV | QVQLVESGGGLVKPGGSLRLSCAVS GFNFSNNGMHWVRQAPGKGLEWVA VISYDGSNKYYTDSVKGRFTISRDNS KNTLYLQMNSLRTEDTAVYYCAKV YYGSGIYYKKRYYYGMDVWGQGTT VTVSSGGGGSGGGGSGGGGSSYELT QPLSVSEALGQTARITCGGNIGSKN VHWYQQKPGQAPVLVIYRDSNRPSG IPERFSGSNSGNAATLTISRVEAGDEA DYYCQVWDSSSDHVVFGGGTQLTV L |
| 1102 | MPK20299-A3_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSYELTQ PPSVSVAPGQTARITCGGNNIGSKNV HWYQQKPGQAPVLVIYRNSNRPSGIP ERFSGSNSGNTATLTISGTQAMDEAD YYCQAWDSSNVVFGGGTQLTVL |
| 1103 | MPK20297-B4_SCFV | QVQLVESGGGVVQPGRSLRLSCVVS GFNFSRNGMHWVRQVPGRGLDWVA VISNDGSNKYYADSVKGRFTISRDNS KNTLYLQMNSLRAEDTAVYYCAKV YYGSGIYYKNNYYYGMDVWGQGTT VTVSSGGGGSGGGGSGGGGSSYELT QPLSVSVALGQTARITCGGNNIGSQN VHWYQQKPGQAPVLVIYRDSNRPSG IPDRFSGSKSGNTATLTISRAQAGDEA DYYCQVWDSSTVVFGGGTQLTVL |
| 1104 | MPK20298-F6_SCFV | QVQLVESGGGVVQPGRSLRLSCVVS GFNFSRNGMHWVRQVPGRGLDWVA |

TABLE 20-continued

Amino acid sequences.

| SEQ ID NO: | Designation | Sequence |
|---|---|---|
| | | VISNDGSNKYYADSVKGRFTISRDNS KNTLYLQMNSLRAEDTAVYYCAKV YYGSGIYYKNRYYYGMDVWGQGTT VTVSSGGGGSGGGGSGGGGSSYELT QPPSVSVAPGQTARITCGGNNIGSKN VHWYQQKPGQAPVLVIYRDSNRPSG IPERFSGSKSGTTATLTISRAQAGDEA EYYCQVWDSSTVVFGGGTELTVL |
| 1105 | MPK20299-H3_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PLSVSVALGQTARITCGGNNIGSKNV HWYQQKPGQAPVLAIYRNSNRPSGIP ERFTGSNSGNTATLTISRAQAGDESD YYCQIWDSSTVVFGGGTKLTVL |
| 1106 | MPK20298-B9_SCFV | QVQLVESGGGVVQPGRSLRLSCAAS GFNFSRNGMHWVRQVPGRGLDWVA VISNDGSNKYYADSVKGRFTISRDNS KNTLYLQMNSLRAEDTAVYYCAKV YYGSGIYYKKNYYYGMDVWGQGTT VTVSSGGGGSGGGGSGGGGSSYELT QPPSVSVALGQTARISCGGNNIGSKN VHWYQQKPGQAPVLVIYRDSNRPSG IPERFSGSKSGTTATLTISRAQAGDEA EYYCQVWDSSTVVFGGGTQLTVL |
| 1107 | MPK20299-E2_SCFV | QVQLVESGGGVVQPGRSLRLSCAVS GFNFSNNGMHWVRQAPGKGLEWVA VISYDGSNKYYTDSVKGRFTISRDNS KNTLYLQMNSLRTEDTAVYYCAKV YYGSGIYYKKRYYYGMDVWGQGTT VTVSSGGGGSGGGGSGGGGSSYELT QPPSVSVALGQTARITCEGNNIGSQN VHWYQQKPGQAPVLVMYRDSNRPS GIPERFSGSKSGNTATLAISRAQAGDE SDYYCQVWDGSAVVFGGGTKLTVL |
| 1108 | MPK20299-D6_SCFV | QVQLVESGGGVVQPGRSLRLSCAAS GFTFSSYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PLSVSVALGQTARITCEGNNIGSQNV HWYQQKPGQAPVLVMYRDSNRPSGI PERFSGSKSGNTATLAISRAQAGDES DYYCQVWDGSAVVFGGGTQLTVL |
| 1109 | MPK20299-A4_SCFV | QVQLVESGGGVVQPGRSLRLSCAAS GFTFSNYGFHWVRQTPGKGLEWVA VISYDGSNRYYADSVKGRFTISRDNS KNTLYLQMNSLRGEDTALYYCARV YYGSGTYYKNRYYYGMDVWGQGT TVTVSSGGGGSGGGGSGGGGSSYEL TQPPSVSVALGQTARITCGGHNIGSK GVHWYQQKPGQAPVLVIYRNSNRPS GIPERFSGSNSGNTATLTISGTQAMDE ADYYCQAWDSGTVVFGGGTQLTVL |
| 1110 | MPK20300-G5_SCFV | QVQLVESGGGVVQPGRSLRLSCAAS GFTFSNYGFHWVRQTPGKGLEWVA VISYDGSNRYYADSVKGRFTISRDNS KNTLYLQMNSLRGEDTALYYCARV YYGSGTYYKNRYYYGMDVWGQGT TVTVSSGGGGSGGGGSGGGGSSYEL TQPPSVSVALGQTARITCGANNIGSK NVHWYQQKPGQPPVLVIYRDFNRPS GIPERFSASNSGNTATLTISRGQAGDE ADYYCQVWDSSTGNVFGGGTKLT VL |

TABLE 20-continued

Amino acid sequences.

| SEQ ID NO: | Designation | Sequence |
|---|---|---|
| 1111 | MPK20299-C3_SCFV | QVQLVESGGGVVQPGRSLRLSCAAS GFIFSNYGFHWVRQTPGKGLEWVAV ISYDGSNKYYADSVKGRFTISRDNSK NTLYLQMNSLRGEDTAVYYCARVY YGSGSYYKNRYYYGMDVWGQGTT VTVSSGGGGSGGGGSGGGGSSYELT QPPSVSVAPGQTARITCGGNNIGSKN VHWYQQKPGQAPVLVIYRDSNRPSG IPERFSGSKSGTTATLTISRAQAGDEA DYYCQVWDSSTVVFGGGTELTVL |
| 1112 | MPK20299-B7_SCFV | QVQLVESGGGVVQPGRSLRLSCAAS GFNFSNYGMHWVRQAPGKGLEWVA VISYDGSNRYYADSVKGRFTISRDNS KNTLYLQMNSLRAEDTAVYFCARVY YGSGIYYKKRYYYGMDVWGQGTTV TVSSGGGGSGGGGSGGGGSSYELTQ SSSVSVAPGQTARITCGGNNIGSKNV HWYQQKPGQAPVLVIYRDSNRPSGIP ERFSGSKSGTTATLTISRVEAGDEAD YYCQVWDSSSAHVIFGGGTKLTVL |
| 1113 | MPK20299-A5_SCFV | QVQLVESGGGVVQPGRSLRLSCGAS GFTFSGYGMHWVRQAPGKGLEWVA VISYDGSNKYYADSVKGRFTISRDNS KNTLYLQMNSLRGEDTAVYYCARV YYGSGIYYKNRYYYGMDVWGQGTT VTVSSGGGGSGGGGSGGGGSSYELT QPPSGSVALGQTARITCGGNNLGSKN VHWYQQKPGQAPVLVIYRNSNRPSG IPERFSGSNSGNTATLTISRAQAGDEA DYYCQVWDSSTVVFGGGTKLTVL |
| 1114 | MPK20299-D1_SCFV | QVQLVESGGGLVKPGGSLRLSCAAS GFTFSNNGMHWVRQAPGKGLEWVA VISYDGSNKYYADSVKGRFTISRDNS KNTLYLQMNSLRAEDTAVYYCAKV YYGSGIYYKNRYYYGMDVWGQGTT VTVSSGGGGSGGGGSGGGGSSYELT QPPSVSVALGQTARITCGGNRIGSKN VHWYQQKPGQAPVLVIYRDSNRPSG IPERFSGSKSGTTATLTISRAQAGDEA EYYCQVWDSSTVVFGGGTKLTVL |
| 1115 | MPK20299-C5_SCFV | QVQLVESGGGVVQPGRSLRLSCAAS GFTFSNYGFHWVRQTPGKGLEWVA VISYDGSNRYYADSVKGRFTISRDNS KNTLYLQMNSLRGEDTALYYCARV YYGSGTYYKNRYYYGMDVWGQGT TVTVSSGGGGSGGGGSGGGGSSYEL TQLPSVSVALGQTARITCGGHNIGSK GVHWYQQKPGQAPVLVIYRNSNRPS GIPERFSGSNSGNTATLTISRAQAGDE ADYYCQVWDSSTVVFGGGTELTVL |
| 1116 | MPK20299-B5_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKNRYYYGMDVWGQGTTV TVSSGGGGSGGGGSGGGGSSYELTQ PPSVSVALGQTARITCGGHNIGSKGV HWYQQKPGQAPVLVIYRNSNRPSGIP ERFSGSNSGNTATLTISRAQAGDEAD YYCQVWDSSTVVFGGGTQLTVL |
| 1117 | MPK20299-G9_SCFV | QVQLVESGGGDLVQPGRSLRLSCAAS GFTFSNNGMHWVRQAPGKGLEWVA VISNDGSNKYYADSVRGRFTISRDNS KNTLYLQMNSLRAEDTAVYYCAKV YYGSGIYYKNRYYYGMDVWGQGTT VTVSSGGGGSGGGGSGGGGSSYELT QPLSVSVALGQTARITCGGNNIGSKN VHWYQQKPGQAPVLVIYRNSNRPSG |

TABLE 20-continued

Amino acid sequences.

| SEQ ID NO: | Designation | Sequence |
|---|---|---|
| | | IPERFSGSNSGNTATLTLSRVQAGDE ADYYCQVWDSSTVVFGGGTKLTVL |
| 1118 | MPK20299-G5_SCFV | QVQLVESGGGVVQPGRSLRLSCAVS GFNFSNNGMHWVRQAPGKGLEWVA VISNDGSNKYYADSVRGRFTISRDNS KNTLYLQMDSLRTEDTAVYYCAKV YYGSGIYYKNRYYYGMDVWGQGTT VTVSSGGGGSGGGGSGGGGSSYELT QPPSVSVALGQTARLTCEGNNIGSKN VHWYQQKPGQAPVLVIYRDSNRPSG IPERFSGSKSGNTATLAISRAQAGDES DYYCQVWDSSAVVFGGGTKLTVL |
| 1119 | MPK20298-C10_SCFV | QVQLVESGGGVVQPGRSLRLSCAAS GFTFSSSGMHWVRQAPGKGLEWVA VISNDGSNKYYADSVRGRFTISRDNS KNTLYLQMNSLRAEDTAVYYCAKV YYGSGIYYKNNYYYGMDVWGQGTT VTVSSGGGGSGGGGSGGGGSSYELT QPPSVSVALGQTARITCGGNIGSKN VHWYQQKPGQAPVLAIYRNSNRPSG IPERFTGSNSGNTATLTISGTQAMDE ADYYCQAWDSSTVVFGGGTKLTVL |
| 1120 | MPK20298-B5_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PPSVSVALGQTARITCGGNNIGSQNV HWYQQKPGQAPVLVIYRDSNRPSGIP ERFSGSKSGNTATLAISRAQAGDESD YYCQVWDSSAVVFGGGTQLTVL |
| 1121 | MPK20299-F2_SCFV | QVQLVESGGGVVQPGRSLRLSCAAS GFTLSSSGMHWVRQAPGKGLEWVA VISNDGSNKYYADSVKGRFTISRDDS KNTLYLQMDSLRTEDTAVYYCAKV YYGSGIYYKNRYYYGMDVWGQGTT VTVSSGGGGSGGGGSGGGGSSYELT QPPSVSVALGQTARISCGGNNIGSKN VHWYQQKPGQAPVLVMYRDSNRPS GIPERFSGSNSGNTATLTISGTQAMDE ADYYCQAWDSGTVVFGGGTKLTVL |
| 1122 | MPK20298-D4_SCFV | QVQLVESGGGVVQPGRSLRLSCAAS GFNFSNYGMHWVRQAPGKGLEWVA VISYDGSNKYYADSVKGRFTISRDNS KNTLYLQMNSLRAEDTAVYFCARVY YGSGIYYKKRYYYGMDVWGQGTTV TVSSGGGGSGGGGSGGGGSSYELTQ PPSVSVALGQTARITCGGNNIGGKNV HWYQQKPGQAPVLVIYRDSNRPSGIP ERFSGSKSGNTATLTISRAQAGDESD YYCQVWDSSTVVFGGGTQLTVL |
| 1123 | MPK20297-F5_SCFV | QVQLVESGGGVVQPGRSLRLSCVVS GFNFSRNGMHWVRQVPGRGLDWVA VISNDGSNKYYADSVKGRFTISRDNS KNTLYLQMNSLRAEDTAVYYCAKV YYGSGIYYKNNYYYGMDVWGQGTT VTVSSGGGGSGGGGSGGGGSSYELT QPLSVSVALGQTARITCGGNNIGSKN VHWYQQKPGQAPVLVIYRNSNRPSG IPERFSGSNSGNTATLTISRAQAGDEA DYYCQVWDSSTVVFGGGTKLTVL |
| 1124 | MPK20299-D9_SCFV | QVQLVESGGGLVKPGGSLRLSCAAS GFNFSRNGMHWVRQVPGRGLDWVA VISNDGSNKYYADSVKGRFTISRDNS KNTLYLQMNSLRAEDTAVYYCAKV YYGSGIYYKNNYYYGMDVWGQGTT VTVSSGGGGSGGGGSGGGGSSYELT |

TABLE 20-continued

Amino acid sequences.

| SEQ ID NO: | Designation | Sequence |
|---|---|---|
| | | QPPSVSVALGQTARISCGGNNIESKN VHWYQQKPGQAPVLVIYRDSNRPSG IPERFSGSKSGTTATLTISRAQAGDEA EYYCQVWDSSTVVFGGGTQLTVL |
| 1125 | huCCR8_32360_huIgG1z mAb(LC:K38R)_HC | EVQLVESGGGLVKPGGSLRLSCAAS GFTFSNARMGWVRQAPGKGLEWVG RIKSKTEGGTRDYAAPVKGRFTISRD DSKNTLYLQMNSLKTEDTAVYYCTS YSGVWGQGTMVTVSSASTKGPSVFP LAPSSKSTSGGTAALGCLVKDYFPEP VTVSWNSGALTSGVHTFPAVLQSSG LYSLSSVVTVPSSSLGTQTYICNVNH KPSNTKVDKKVEPKSCDKTHTCPPCP APELLGGPSVFLFPPKPKDTLMISRTP EVTCVVVDVSHEDPEVKFNWYVDG VEVHNAKTKPREEQYNSTYRVVSVL TVLHQDWLNGKEYKCKVSNKALPA PIEKTISKAKGQPREPQVYTLPPSREE MTKNQVSLTCLVKGFYPSDIAVEWE SNGQPENNYKTTPPVLDSDGSFFLYS KLTVDKSRWQQGNVFSCSVMHEAL HNHYTQKSLSLSPGK |
| 1126 | huCCR8_32360_huIgG1z mAb(LC:K38R)_LC | DIVMTQSPDSLAVSLGERATINCKSS QSVLYSSNNRNYLAWYHQKPGQSPK LLISWASTRESGVPDRFSGSGSGTDFT LTINSLQAEDVAVYYCQQYYSIPITFG GGTKVEIKRTVAAPSVFIFPPSDEQLK SGTASVVCLLNNFYPREAKVQWKVD NALQSGNSQESVTEQDSKDSTYSLSS TLTLSKADYEKHKVYACEVTHQGLS SPVTKSFNRGEC |
| 1127 | anti-huCCR8_44379(VH:D72S, VL:N67A_S68A_M99G_W109F_S111A)_huIgG1z (mAb)_HC | QVQLVESGGGVVQPGRSLRLSCAAS GFTFSNYGFHWVRQTPGKGLEWVA VISYDGSNRYYASSVKGRFTISRDNS KNTLYLQMNSLRGEDTALYYCARV YYGSGTYYKNRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1128 | anti-huCCR8_44379(VH:D72S, VL:N67A_S68A_M99G_W109F_S111A)_huIgG1z (mAb)_LC | SYELTQPPSVSVALGQTARITCGGHN IGSKGVHWYQQKPGQAPVLVIYRAA NRPSGIPERFSGSNSGNTATLTISGTQ AGDEADYYCQAFDAGTVVFGGGTQ LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1129 | anti-huCCR8_44379(VH:D61A_D72A, VL:N67Q_M99E_W109F_S111A)_huIgG1z (mAb)_HC | QVQLVESGGGVVQPGRSLRLSCAAS GFTFSNYGFHWVRQTPGKGLEWVA VISYAGSNRYYASVKGRFTISRDNS KNTLYLQMNSLRGEDTALYYCARV YYGSGTYYKNRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH |

TABLE 20-continued

Amino acid sequences.

| SEQ ID NO: | Designation | Sequence |
|---|---|---|
| | | EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1130 | anti-huCCR8_44379(VH:D61A_D72A, VL:N67Q_M99E_W109F_S111A)_huIgG1z (mAb)_LC | SYELTQPPSVSVALGQTARITCGGHN IGSKGVHWYQQKPGQAPVLVIYRQS NRPSGIPERFSGSNSGNTATLTISGTQ AEDEADYYCQAFDAGTVVFGGGTQ LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1131 | anti-huCCR8_44379(VH:D61S, VL:N67Q_M99G_W109F_S111A)_huIgG1z (mAb)_HC | QVQLVESGGGVVQPGRSLRLSCAAS GFTFSNYGFHWVRQTPGKGLEWVA VISYSGSNRYYADSVKGRFTISRDNS KNTLYLQMNSLRGEDTALYYCARV YYGSGTYYKNRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1132 | anti-huCCR8_44379(VH:D61S, VL:N67Q_M99G_W109F_S111A)_huIgG1z (mAb)_LC | SYELTQPPSVSVALGQTARITCGGHN IGSKGVHWYQQKPGQAPVLVIYRQS NRPSGIPERFSGSNSGNTATLTISGTQ AGDEADYYCQAFDAGTVVFGGGTQ LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1133 | Hu anti-huCCR8 LIBC315615-1 HuIgG1z mAb_LC | SYELTQPLSVSVALGQTARITCGGHN IGSKGVHWYQQKPGQAPVLVIYRNS NRPSGIPERFSGSNSGNTATLTISRAQ AGDEADYYCQVWDISTVVFGGGTEL TVLGQPKAAPSVTLFPPSSEELQANK ATLVCLISDFYPGAVTVAWKADSSP VKAGVETTTPSKQSNNKYAASSYLS LTPEQWKSHRSYSCQVTHEGSTVEK TVAPTECS |
| 1134 | Hu anti-huCCR8 LIBC315615-1 HuIgG1z mAb_HC | QVQLVESGGGVAQPGRSLRLSCAAS GFNFSNCGMHWVRQAPGKGLEWVA VISYDGGNKYHADSVKGRFTISRDDS KNTLYLQMDSLRTEDTAVYYCAKV YYGSGIYYKNRYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT |

TABLE 20-continued

Amino acid sequences.

| SEQ ID NO: | Designation | Sequence |
|---|---|---|
| | | TPPVLDSDGSFFLYSKLTVDKSRWQQ GNVFSCSVMHEALHNHYTQKSLSLS PGK |
| 1135 | Hu anti-huCCR8 LIBC317152-1 HuIgG1z mAb_LC | SYELTQPLSVSVALGQTARITCGGHN IGSKGVHWYQQKPGQAPVLVIYRNS NRPSGIPERFSGSNSGKTATLTISRAQ AGDEADYYCQVWDSSTVVFGGGTE LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1136 | Hu anti-huCCR8 LIBC317152-1 HuIgG1z mAb_HC | QVQLVESGGGVAQPGRSLRLSCAAS GFNFSNCGMHWVRQAPGKGLEWVA VISYDGGNKYYADSVKGRFTISRDDS KNTLYLQMDSLRTEDTAVYYCAKV YYGSGIYYKNRYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1137 | Hu anti-huCCR8 LIBC317471-1 HuIgG1z mAb_LC | SYELTQPLSVSVALGQTARITCGGNN IGSKNVHWYQKRPGQAPVLVIYRDS NRPSGIPERFSGSKSGNTATLTISRAQ AGDEADYYCQVWDSNTVVFGGGTN LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1138 | Hu anti-huCCR8 LIBC317471-1 HuIgG1z mAb_HC | QVQLVESGGGVVQPGRSLRLSCVVS GFNFSNNGMHWVRQAPGKGLEWVA VISNDGSNKYYADSVRGRFTISRDNS KNTLYLQMNSLRAEDTAVYSCAKV YYGSGIYYKNNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1139 | Hu anti-huCCR8 LIBC317977-1 HuIgG1z mAb_LC | SYELTQPLSVSVALGQTARITCGGNN IGSKNVHWYQQKAGQAPVQVIYRNS NRPSGIPERFSGSNSGNTATLTISRAQ AGDEADYYCQVWDSSTVVFGGGTK LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |

TABLE 20-continued

Amino acid sequences.

| SEQ ID NO: | Designation | Sequence |
|---|---|---|
| 1140 | Hu anti-huCCR8 LIBC317977-1 HuIgG1z mAb_HC | QVQLVESGGGVVQPGRSLRLSCAAS GFNFNTYGMHWVRQAPGKGLEWVA VISYDGSNKYYADSVKGRFTISRDNS KSTLYLQMNSLRAEDTAVYYCARVY YGSGSYYKKNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1141 | Hu anti-huCCR8 LIBC318774-1 HuIgG1z mAb_LC | SYELTQPLSVSVALGQTARITCGGNN IGGKNVHWYQQKPGQAPVLVIYRDS NRPSGIPERFSGSKSGNTATLTISRAQ AGDESDYYCQVWDSSTVVFGGGTTL TVLGQPKAAPSVTLFPPSSEELQANK ATLVCLISDFYPGAVTVAWKADSSP VKAGVETTTPSKQSNNKYAASSYLS LTPEQWKSHRSYSCQVTHEGSTVEK TVAPTECS |
| 1142 | Hu anti-huCCR8 LIBC318774-1 HuIgG1z mAb_HC | QVQVVESGGGVVQPGRSLRLSCAAS GFTLSSYGFHWVRQTPGKGLEWVAV ISYDGSNKYYADSVKGRFTISRDNSK NTLYLQMNSLRGEDTAVYYCARVY YGSGTYYKNRYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1143 | Hu anti-huCCR8 LIBC319840-1 HuIgG1z mAb_LC | SYELTQPLSVSEALGQTARITCGGNNI GSKNVHWYQQKPGQAPVLVIYRDSN RPSGIPERFSGSKSGNTATLTISRAQA GDEADYYCQVWDSSTVVFGGGTKV TVLGQPKAAPSVTLFPPSSEELQANK ATLVCLISDFYPGAVTVAWKADSSP VKAGVETTTPSKQSNNKYAASSYLS LTPEQWKSHRSYSCQVTHEGSTVEK TVAPTECS |
| 1144 | Hu anti-huCCR8 LIBC319840-1 HuIgG1z mAb_HC | QVQLVESGGGVVQPGRSLRLSCVVS GFNFINNGMHWVRQAPGKGLDWVA VISNDGSNKYYPDSVKGRFTISRDNS KNTLYLQMNSLRAEDSAVYYCAKV YYGSGNYYKNNYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ |

TABLE 20-continued

Amino acid sequences.

| SEQ ID NO: | Designation | Sequence |
|---|---|---|
| | | PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1145 | Hu anti-huCCR8 LIBC320212-1 HuIgG1z mAb_LC | SYELTQPLSVSVALGQTARITCEGNNI GSQNVHWYQQKPGQAPVLVMYRDS NRPSGIPERFSGSKSGNTATLAISRAQ AGDESDYYCQVWDGSAVVFGGGTT LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1146 | Hu anti-huCCR8 LIBC320212-1 HuIgG1z mAb_HC | QMQVVESGGGVVQPGRSLRLSCAAS GFTFSSSGMHWVRQAPGKGLEWVA VISHDGSNKYYADSVKGRFTISRDNS KNTLYLQMNSLGGEDTAVYYCAKV YYGSGIYYKNRYYYGMDVWGQGTT VIVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1147 | Hu anti-huCCR8 LIBC320384-1 HuIgG1z mAb_LC | SYELTQPLSVSVALGQTARITCGGHN IGSKGVHWYQQKPGQAPVLVIYRNS NRPSGIPERFSGSNSGNTATLTISRAQ AGDEADYYCQVWDSSTVVFGGGTE LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1148 | Hu anti-huCCR8 LIBC320384-1 HuIgG1z mAb_HC | QVQLVESGGGVAQPGRSLRLSCAAS GFNFSDCGMHWVRQAPGKGLEWVA VISYDGGNKYYADSVKGRFTISRDDS KNTLYLQTDSLRTEDTAVYYCAKVY YGSGIYYKNRYYYGMDVWGQGTTV TVSSASTKGPSVFPLAPSSKSTSGGTA ALGCLVKDYFPEPVTVSWNSGALTS GVHTFPAVLQSSGLYSLSSVVTVPSS SLGTQTYICNVNHKPSNTKVDKKVE PKSCDKTHTCPPCPAPELLGGPSVFLF PPKPKDTLMISRTPEVTCVVVDVSHE DPEVKFNWYVDGVEVHNAKTKPRE EQYNSTYRVVSVLTVLHQDWLNGK EYKCKVSNKALPAPIEKTISKAKGQP REPQVYTLPPSREEMTKNQVSLTCLV KGFYPSDIAVEWESNGQPENNYKTTP PVLDSDGSFFLYSKLTVDKSRWQQG NVFSCSVMHEALHNHYTQKSLSLSP GK |
| 1149 | Hu anti-huCCR8 LIBC320689-1 HuIgG1z mAb_LC | SYELTQPLSVSVALGQTGRITCGGNN IGSKNVHWYQQKPGQAPVLVIYRSS NRPSGIPERFSGSNSGNTATLTISRAQ AGDESDYYCQIWDSSTVVFGGGTKL TVLGQPKAAPSVTLFPPSSEELQANK ATLVCLISDFYPGAVTVAWKADSSP VKAGVETTTPSKQSNNKYAASSYLS LTPEQWKSHRSYSCQVTHEGSTVEK TVAPTECS |

TABLE 20-continued

Amino acid sequences.

| SEQ ID NO: | Designation | Sequence |
|---|---|---|
| 1150 | Hu anti-huCCR8 LIBC320689-1 HuIgG1z mAb_HC | QVQVVESGGGVVQPGRSLRLSCAAS GFTFSSYGMHWVRQAPGKGLEWVA VISFDGNNKYYADSVKGRFTISRDNS KNTLYLQMNSLRGEDTAVYYCARV YYGSGSYYKNRYYYGMDVWGQGT TVTVSTASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1151 | Hu anti-huCCR8 LIBC321408-1 HuIgG1z mAb_LC | SYELTQPLSVSVALGQTARITCGGNN IGSKNVHWYQQRPGQAPVLVIYRDS NRPSGIPERLSGSKAGNTATLTISRAH AGDEADYYCQVWDSSTVVFGGGTE LTVQGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1152 | Hu anti-huCCR8 LIBC321408-1 HuIgG1z mAb_HC | QVQLVESGGGVVQPGRSLRLSCAVS GFTFSSNGMHWVRQAPGKGLEWVA VISNDGSNKYYGDSVKGRFTISRDNS KNTLYLQMNSLRAEDTAVYYCAKV YYGSGIYYRNNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1153 | Hu anti-huCCR8 LIBC321824-1 HuIgG1z mAb_LC | SYELTQPLSVSVALGQTARITCGGNN IGSKNVHWYQQKPGQAPILVIYRNTN RPSGIPERFSGSNSGNTATLTISRAQV GDESDYFCQVWDSSTVVFGGGTKLT VLGQPKAAPSVTLFPPSSEELQANKA TLVCLISDFYPGAVTVAWKADSSPV KAGVETTTPSKQSNNKYAASSYLSLT PEQWKSHRSYSCQVTHEGSTVEKTV APTECS |
| 1154 | Hu anti-huCCR8 LIBC321824-1 HuIgG1z mAb_HC | QVQVVESGGGVVQPGRSLRLSCGAS GFTFSGYGMHWVRQAPGKGLEWVA VISYDGSNKYYADSVKGRFPISRDNS KNTLYLQMNSLRGEDTAVYYCARV YYGSGIYYKNRYYYGMDVWGQGTT VAVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ |

TABLE 20-continued

Amino acid sequences.

| SEQ ID NO: | Designation | Sequence |
|---|---|---|
| | | PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1155 | Hu anti-huCCR8 LIBC321845-1 HuIgG1z mAb_LC | SYELTQPLSVSVALGQTARITCGGNN IGSKNVHWYQQKPGQAPILVIYRNTN RPSGIPERFSGSNSGNTATLTISRAQV GDESDYFCQVWDSSTVVFGGGTKLT VLGQPKAAPSVTLFPPSSEELQANKA TLVCLISDFYPGAVTVAWKADSSPV KAGVETTTPSKQSNNKYAASSYLSLT PEQWKSHRSYSCQVTHEGSTVEKTV APTECS |
| 1156 | Hu anti-huCCR8 LIBC321845-1 HuIgG1z mAb_HC | QVQVVESGGGVVQPGRSLRLSCGAS GFTFSGYGMHWVRQAPGKGLEWVA VISYDGSNKYYADSVKGRFTISRDNS KNTLYLQMNSLRGEDTAVYYCARV YYGSGIYYKNRYYYGMDVWGQGTT VAVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1157 | Hu anti-huCCR8 LIBC322176-1 HuIgG1z mAb_LC | SYDLTQPLSVSVALGQTARITCGGNN IGDKNVHWYQQKPGQAPVLVIYRNN VRPSGIPERFSGSNSGNTATLTISRAQ AGDEADYYCQVWDSSTVVFGGGTK LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |
| 1158 | Hu anti-huCCR8 LIBC322176-1 HuIgG1z mAb_HC | QVQLVESGGGVVQPGRSLRLSCAAS GLNFSNFGMHWVRQAPGKGLDWVA VISYDGGNKYYADSVKGRFTVSRDN SKNTLFLQMNSLRAEDTALYYCAKV YYGSGSYYKKRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PGK |
| 1159 | Hu anti-huCCR8 LIBC323412-1 HuIgG1z mAb_LC | SYELTQPLSVSVALGQTARITCGGNN IGSKNVHWYQQKPGQAPVLVIYRDS NRPSGIPERFSGSKSGNTATLTISRAQ AGDEADYYCQVWDSSTVVFGGGAK LTVLGQPKAAPSVTLFPPSSEELQAN KATLVCLISDFYPGAVTVAWKADSS PVKAGVETTTPSKQSNNKYAASSYLS LTPEQWKSHRSYSCQVTHEGSTVEK TVAPTECS |

TABLE 20-continued

Amino acid sequences.

| SEQ ID NO: | Designation | Sequence |
|---|---|---|
| 1160 | Hu anti-huCCR8 LIBC323412-1 HuIgG1z mAb_HC | QVQLVESGGGVVQPGRSLRLSCAASGFNFSSCGMHWVRQAPGKGLEWVAVISYDGTNKYYADSVKGRFTISRDNSKNTLYLQMNSLRAEDTAVYYCAKVYYGSGIYYKKNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1161 | huCCR8_32360_huIgG1z mAb_HC | EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 1162 | huCCR8_32360_huIgG1z mAb_LC | DIVMTQSPDSLAVSLGERATINCKSSQSVLYSSNKNYLAWYHQKPGQSPKLLISWASTRESGVPDRFSGSGSGTDFTLTINSLQAEDVAVYYCQQYYSIPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 1163 | MPK20298-A4_SCFV | CAGGTGCAGCTGGTGGAGTCTGGGGGAGGCGTGGTCCAGCCTGGGAGGTCCCTGAGACTCTCCTGTGTAGTCTCTGGATTCAACTTCAGTAACAATGGCATGCACTGGGTCCGCCAGGCTCCAGGCAAGGGACTGGAGTGGGTGGCAGTTATTTCAAATGATGGAAGTAATAAATACTATGCAGACTCCGTGAAGGGCCGATTCACCATCTCCAGAGACAATTCCAAGAACACGCTGTATCTACAAATGAACAGCCTGAGAACTGAGGACACGGCTGTGTATTACTGTGCGAAAGTTTACTATGGTTCGGGTATTTATTATAAAAACAGGAACTACTACGGTATGGACGTCTGGGGCCAAGGGACCACGGTCACCGTCTCCTCAGGTGGTGGTGGTTCTGGCGGCGGCGGCTCCGGTGGTGGTGGTTCTTCATATGAGCTGACTCAGCCACCCTCAGTGTCAGTGGCCCTGGGACAGACGGCCAGGATTACCTGTGGGGAAACAACATTGGAAGTCAAATGTGCACTGGTACCAGCAGAAGCCAGGCCAGGCCCCTGTGCTGGTCATCTATAGGGATAGCAACCGGCCCTCTGGGATCCCTGACCGATTC |

TABLE 20-continued

Amino acid sequences.

| SEQ ID NO: | Designation | Sequence |
|---|---|---|
| | | TCTGGCTCCAAGTCGGGGAACACG<br>GCCACCCTGACCATCAGCAGAGCC<br>CAAGCCGGGGATGAGGCTGACTAT<br>TACTGTCAGGTGTGGGACAGCAGC<br>ACTGTGGTTTTCGGCGGAGGGACC<br>AAGCTGACCGTCCTA |
| 1164 | MPK20299-D2_SCFV | CAGGTGCAGCTGGTGGAGTCTGGG<br>GGAGGCGTGGTCCAGCCTGGGAGG<br>TCCCTGAGACTCTCCTGTGCAGCCT<br>CTGGATTCAACTTCAGTAACTATGG<br>CATGCACTGGGTCCGCCAGGCTCCA<br>GGCAAGGGGCTGGAATGGGTGGCA<br>GTTATATCATATGATGGAAGTAATA<br>AATATTATGCAGACTCCGTGAAGG<br>GCCGATTCACCATCTCCAGAGACA<br>ATTCCAAGAACACGCTGTATCTACA<br>AATGAACAGCCTGAGAGCTGAGGA<br>CACGGCTGTGTATTTCTGTGCGAGA<br>GTTTACTATGGTTCGGGGATTTATT<br>ATAAAAAGAGATACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCAGTGTCAGTGGC<br>CCTGGGACAGACGGCCAGGATTAC<br>CTGTGGGGGACACAACATTGGAAG<br>TAAAGGTGTGCACTGGTACCAGCA<br>GAAGCCAGGCCAGGCCCCTGTGCT<br>GGTCATCTATAGGAATAGCAACCG<br>GCCCTCTGGGATCCCTGAGCGATTC<br>TCTGGCTCCAACTCGGGGAACACG<br>GCCACCCTGACCATCACCAGAGCC<br>CAAGCCGGGGATGAGGCTGACTAT<br>TACTGTCAGGTGTGGGACAGCAGC<br>ACTGTGGTTTTCGGCGGAGGGACC<br>AAGCTGACCGTCCTA |
| 1165 | MPK20299-F11_SCFV | CAGGTGCAGCTGGTGGAGTCCGGG<br>GGAGGCGTGGTCCAGCCTGGGAGG<br>TCCCTGAGACTCTCCTGTGCACCCT<br>CTGGATTCAACTTCAGTAACTATGG<br>CATGCACTGGGTCCGCCAGGCTCCA<br>GGCAAGGGGCTGGAGTGGGTGGCA<br>GTTATATCATATGATGGAAGTAATA<br>AATATTATGCAGACTCCGTGAAGG<br>GCCGATTCACCATCTCCAGAGACA<br>ATTCCAAAAACACGCTGTTTCTGCA<br>AATGAACAGCCTGAGAGCTGAGGA<br>CACGGCTGTGTATTTCTGTGCGAGA<br>GTTTACTATGGTTCGGGGAGTTATT<br>ATAAAAAGAGATACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCAGTGTCAGTGGC<br>CCTGGGACAGACGGCCAGGATTAC<br>CTGTGGGGGAAACAACATTGGAAG<br>TCAAAATGTGCACTGGTACCAGCA<br>GAAGCCAGGCCAGGCCCCTGTGCT<br>GGTCATCTATAGGGATAGCAACCG<br>GCCCTCTGGGATCCCTGAGCGATTC<br>TCTGGCTCCAAGTCGGGGAACACG<br>GCCACCCTGACCATCAGCAGAGCC<br>CAAGCCGGGGATGAGGCTGACTAT<br>TACTGTCAGGTGTGGGACAGCAGC<br>ACTGTGGTTTTCGGCGGAGGCACCC<br>AGCTGACCGTCCTA |
| 1166 | MPK20298-H6_SCFV | CAGGTGCAGCTGGTGGAGTCCGGG<br>GGAGGCGTGGTCCAGCCTGGGAGG<br>TCCCTGAGACTCTCCTGTGCAGCGT<br>CTGGATTCACCTTCAGTAGCTCTGG |

TABLE 20-continued

Amino acid sequences.

| SEQ ID NO: | Designation | Sequence |
|---|---|---|
| | | CATGCACTGGGTCCGCCAGGCTCCA GGCAAGGGGCTGGAGTGGGTGGCA GTTATATCATATGATGGAACTAATA AATACTATGCGGACTCCGTGAAGG GCCGATTCACCATCTCCAGAGACA ATTCCAAGAACACGCTGTATCTGCA AATGAACAGCCTGAGAGCTGAGGA CACGGCTGTGTATTACTGTGCGAAA GTTTACTATGGTTCGGGTATTTATT ATAAAAACAGGTACTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCAGTGTCAGTGGC CCTGGGACAGACGGCCAGGATTAC CTGTGGGGACACAACATTGGAAG TAAAGGTGTGCACTGGTACCAGCA GAAGCCAGGCCAGGCCCCTGTGCT GGTCATCTATAGAAATAGCAACCG GCCCTCTGGGATCCCTGAGCGATTC TCTGGCTCCAACTCGGGGAACACG GCCACCCTGACCATCAGCAGAGCC CAAGCCGGGGATGAGGCTGACTAT TACTGTCAGGTGTGGGACAGCAGC ACTGTGGTTTTCGGCGGAGGCACCC AGCTGACCGTCCTA |
| 1167 | MPK20297-A4_SCFV | CAGGTGCAGCTGGTGGAGTCTGGG GGAGGCGTGGTCCAGCCTGGGAGG TCCCTGAGACTCTCCTGTGCAGTCT CTGGATTCAACTTCAGTAACTATGG CATGCACTGGGTCCGCCAGGTTCCA GGCAGGGGGCTAGATTGGGTGGCA GTTATATCAAATGATGGAAGTAAT AAATACTATGCAGACTCCGTGAAG GGCCGATTCACCATTTCCAGAGACA ATTCCAAGAACACACTGTATCTGCA AATGGACAGCCTGAGAACTGAGGA CACGGCTGTGTATTACTGTGCGAAA GTTTACTATGGTTCGGGTATTTATT ATAAAAAGAGATACTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCAGTGTCAGTGGC CCTGGGACAGACGGCCAGGATTAC CTGTGGGGACACAACATTGGAAG TCAAAATGTGCACTGGTACCAGCA GAAGCCAGGCCAGGCCCCTGTGCT GGTCATCTATAGGGATAGCAACCG GCCCTCTGGGATCCCTGAGCGATTC TCTGGCTCCAAGTCGGGGAACACG GCCACCCTGACCATCAGCAGAGCC CAAGCCGGGGATGAGGCTGACTAT TACTGTCAGGTGTGGGACAGCAGC ACTGTGGTTTTCGGCGGAGGCACCC AGCTGACCGTCCTA |
| 1168 | MPK20299-H8_SCFV | CAGGTGCAGCTGGTGGAGTCCGGG GGAGGCGTGGTCCAGCCTGGGAGG TCCCTGAGACTCTCCTGTGCAGCCT CTGGATTCAACTTCAGTAACTATGG CATGCACTGGGTCCGCCAGGCTCCA GGCAAGGGGCTGGAATGGGTGGCA GTTATATCATATGATGGAAGTAATA AATATTATGCAGACTCCGTGAAGG GCCGATTCACCATCTCCAGAGACA ATTCCAAGAACACGCTGTATCTACA AATGAACAGCCTGAGAGCTGAGGA CACGGCTGTGTATTTCTGTGCGAGA GTTTACTATGGTTCGGGGATTTATT ATAAAAAGAGATACTACTACGGGA TGGACGTCTGGGGCCAAGGGACCA |

… TABLE 20-continued

Amino acid sequences.

| SEQ ID NO: | Designation | Sequence |
|---|---|---|
| | | CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCGGTGTCAGTGGC<br>CCCAGGACAGACGGCCAGGATTAC<br>CTGTGGGGAAACAACATTGGAAG<br>TAAAAATGTGCACTGGTACCAGCA<br>GAAGGCAGGCCAGGCCCCTGTGCA<br>GGTCATCTATAGAAATAGCAACCG<br>GCCCTCTGGGATCCCTGCGCGATTC<br>TCTGGCTCCAACTCGGGGAACACG<br>GCCACCCTGACCATCAGCAGAGCC<br>CAGGCCGGGGATGAGGCTGACTAT<br>TACTGTCAGGTGTGGGACAGCAGC<br>ACTGTGGTTTTCGGCGGTGGGACCA<br>AGCTGACCGTCCTA |
| 1169 | MPK20300-C11_SCFV | CAGGTGCAGCTGGTGGAGTCCGGG<br>GGAGGCGTGGTCCAGCCTGGGAGG<br>TCCCTGAGACTCTCCTGTGCAGCCT<br>CTGGATTCACCTTCAGTAGCTATGG<br>CATGCACTGGGTCCGCCAGGCTCCA<br>GGCAAGGGGCTGGAGTGGGTGGCA<br>GTTATATCATATGATGGAAGTAATA<br>AATACTATGCAGACTCCGTGAAGG<br>GCCGATTCACCATCTCCAGAGACA<br>ATTCCAAGAACACGCTGTATCTGCA<br>AATGAACAGCCTGAGAGGTGAGGA<br>CACGGCGGTGTATTACTGTGCGAG<br>AGTTTACTATGGTTCGGGGAGTTAT<br>TATAAAAACCGCTACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCGGTGTCAGTGGC<br>CCCAGGACAGACGGCCAGGATTCC<br>CTGTGGGGAAACAACATTGGAAG<br>TAAAAATGTGCACTGGTACCAGCA<br>GAAGCCAGGCCAGGCCCCTGTACT<br>GGTCATCTATAGGGATATCAACCG<br>GCCCTCTGGGATCCCTGAGCGATTC<br>TCTGGCTCCAACTCGGGGAACACG<br>GCCACCCTGACCATCAGCAGAGCC<br>CAAGCCGGGGATGAGGCTGACTAT<br>TACTGTCAGGTGTGGGACAGCAGC<br>GTGGTATTCGGCGGAGGGACCAAG<br>CTGACCGTCCTC |
| 1170 | MPK20298-B1_SCFV | CAGGTGCAGCTGGTGGAGTCCGGG<br>GGAGGCGTGGTCCAGCCTGGGAGG<br>TCCCTGAGACTCTCCTGTGCAGCCT<br>CTGGATTCAACTTCAGTAACTATGG<br>CATGCACTGGGTCCGCCAGGCTCCA<br>GGCAAGGGGCTGGAATGGGTGGCA<br>GTTATATCATATGATGGAAGTAATA<br>AATATTATGCAGACTCCGTGAAGG<br>GCCGATTCACCATCTCCAGAGACA<br>ATTCCAAGAACACGCTGTATCTACA<br>AATGAACAGCCTGAGAGGTGAGGA<br>CACGGCTGTGTATTTCTGTGCGAGA<br>GTTTACTATGGTTCGGGGATTTATT<br>ATAAAAAGAGATACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCAGTGTCAGTGGC<br>CCTGGGACAGACGGCCAGGCTTAC<br>CTGTGAGGGAAACAACATTGGAAG<br>TAAAAATGTGCACTGGTACCAGCA<br>GAAGCCAGGCCAGGCCCCTGTGCT<br>GGTCATCTATAGGAATAGCAACCG<br>GCCCTCTGGGATCCCTGAGCGATTC<br>TCTGGCTCCAACTCGGGGAACACG |

TABLE 20-continued

Amino acid sequences.

| SEQ ID NO: | Designation | Sequence |
|---|---|---|
| | | GCCACCCTGACTATTAGCAGAGTCC AAGCCGGGGATGAGGCTGACTATT ACTGTCAGGCGTGGGACAGCAGCA CTGTGGTATTCGGCGGAGGCACCC AGCTGACCGTCCTA |
| 1171 | MPK20297-E5_SCFV | CAGGTGCAGCTGGTGGAGTCCGGG GGAGGCCTGGTCAAGCCTGGGGGG TCCCTGAGACTCTCCTGTGCAGTCT CTGGATTCAACTTCAGTAACAATGG CATGCACTGGGTCCGCCAGGCTCCA GGCAAGGGGCTGGAGTGGGTGGCA GTCATATCGTATGATGGAAGTAATA AATACTATACAGACTCCGTGAAGG GCCGATTCACCATCTCCAGAGACA ATTCCAAGAACACGCTGTATCTGCA AATGAACAGCCTGAGAACTGAGGA CACGGCTGTGTATTACTGTGCGAAA GTTTACTATGGTTCGGGTATTTATT ATAAAAAGAGATACTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACTCTCAGTGTCAGAGGC CCTGGGACAGACGGCCAGGATTAC CTGTGGGGAAACAACATTGGAAG TAAAAATGTGCACTGGTACCAGCA GAAGCCAGGCCAGGCCCCTGTACT GGTCATCTATAGGGATAGCAACCG GCCCTCAGGGATCCCTGAGCGATTC TCTGGCTCCAACTCTGGGAACGCGG CCACCCTGACCATCAGTAGGGTCG AAGCCGGGGATGAGGCCGACTATT ACTGTCAGGTGTGGGATAGTAGCA GTGATCATGTGGTATTCGGCGGAG GCACCCAGCTGACCGTCCTA |
| 1172 | MPK20299-A3_SCFV | CAGGTGCAGCTGGTGGAGTCTGGG GGAGGCGTGGTCCAGCCTGGGAGG TCCCTGAGACTCTCCTGTGCAGCCT CTGGATTCAACTTCAGTAACTATGG CATGCACTGGGTCCGCCAGGCTCCA GGCAAGGGGCTGGAATGGGTGGCA GTTATATCATATGATGGAAGTAATA AATATTATGCAGACTCCGTGAAGG GCCGATTCACCATCTCCAGAGACA ATTCCAAGAACACGCTGTATCTACA AATGAACAGCCTGAGAGCTGAGGA CACGGCTGTGTATTTCTGTGCGAGA GTTTACTATGGTTCGGGGATTTATT ATAAAAAGAGATACTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCGGTGTCAGTGGC CCCAGGACAGACGGCCAGGATTAC CTGTGGGGGAAACAACATTGGAAG TAAAAATGTGCACTGGTACCAGCA GAAGCCAGGCCAGGCCCCTGTACT GGTCATCTATAGAAATAGCAACCG GCCCTCTGGGATCCCTGAGCGATTC TCTGGCTCCAACTCTGGGAACACAG CCACTCTGACCATCAGCGGGACCC AGGCTATGGATGAGGCTGACTATT ACTGTCAGGCGTGGGACAGCAGCA ATGTGGTATTCGGCGGAGGCACCC AGCTGACCGTCCTA |
| 1173 | MPK20297-B4_SCFV | CAGGTGCAGCTGGTGGAGTCCGGG GGAGGCGTGGTCCAGCCTGGGAGG TCCCTGAGACTCTCCTGTGTAGTCT CTGGATTCAACTTCAGTAGGAATGG CATGCACTGGGTCCGCCAGGTTCCA |

TABLE 20-continued

Amino acid sequences.

| SEQ ID NO: | Designation | Sequence |
|---|---|---|
| | | GGCAGGGGGCTAGATTGGGTGGCA GTTATATCAAATGATGGAAGTAAT AAATACTATGCAGACTCCGTGAAG GGCCGATTCACCATCTCCAGAGAC AATTCCAAGAACACGCTGTATCTGC AAATGAACAGCCTGAGAGCTGAGG ACACGGCTGTGTATTACTGTGCGAA AGTTTACTATGGTTCGGGGATTTAT TATAAAAATAACTACTATTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACTCTCAGTGTCAGTGGC CCTGGGACAGACGGCCAGGATTAC CTGTGGGGAAACAACATTGGAAG TCAAAATGTGCACTGGTACCAGCA GAAGCCAGGCCAGGCCCCTGTGCT GGTCATCTATAGGGATAGCAACCG GCCCTCTGGGATCCCTGACCGATTC TCTGGCTCCAAGTCGGGGAACACG GCCACCCTGACCATCAGCAGAGCC CAAGCCGGGGATGAGGCTGACTAT TACTGTCAGGTGTGGGACAGCAGC ACTGTGGTTTTCGGCGGAGGCACCC AGCTGACCGTCCTA |
| 1174 | MPK20298-F6_SCFV | CAGGTGCAGCTGGTGGAGTCTGGG GGAGGCGTGGTCCAGCCTGGAGG TCCCTGAGACTCTCCTGTGTAGTCT CTGGATTCAACTTCAGTAGGAATGG CATGCACTGGGTCCGCCAGGTTCCA GGCAGGGGGCTAGATTGGGTGGCA GTTATATCAAATGATGGAAGTAAT AAATACTATGCAGACTCCGTGAAG GGCCGATTCACCATCTCCAGAGAC AATTCCAAGAACACGCTGTATCTGC AAATGAACAGCCTGAGAGCTGAGG ACACGGCTGTGTATTACTGTGCGAA AGTTTACTATGGTTCGGGGATTTAT TATAAAAACCGCTATTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCGGTGTCAGTGGC CCCAGGACAGACGGCCAGGATTAC CTGTGGGGAAACAACATTGGAAG TAAAAATGTGCACTGGTACCAGCA GAAGCCAGGCCAGGCCCCTGTGCT GGTCATCTATAGGGATAGCAACCG GCCCTCTGGGATCCCTGAGCGATTC TCTGGCTCCAAGTCGGGGACCACG GCCACCCTGACCATCAGCAGAGCC CAAGCCGGGGATGAGGCTGAGTAT TACTGTCAGGTGTGGGACAGCAGC ACTGTGGTTTTCGGCGGAGGGACC GAGCTGACCGTCCTA |
| 1175 | MPK20299-H3_SCFV | CAGGTGCAGCTGGTGGAGTCCGGG GGAGGCGTGGTCCAGCCTGGGAGG TCCCTGAGACTCTCCTGTGCAGCCT CTGGATTCAACTTCAGTAACTATGG CATGCACTGGGTCCGCCAGGCTCCA GGCAAGGGGCTGGAATGGGTGGCA GTTATATCATATGATGGAAGTAATA AATATTATGCAGACTCCGTGAAGG GCCGATTCACCATCTCCAGAGACA ATTCCAAGAACACGCTGTATCTACA AATGAACAGCCTGAGAGCTGAGGA CACGGCTGTGTATTTCTGTGCGAGA GTTTACTATGGTTCGGGGATTTATT ATAAAAAGAGATACTACTACGGTA TGGACGTCTGGGGCCAAGGGACCA CGGTCACCGTCTCCTCAGGTGGTGG |

TABLE 20-continued

Amino acid sequences.

| SEQ ID NO: | Designation | Sequence |
|---|---|---|
| | | TGGTTCTGGCGGCGGCGGCTCCGGT
GGTGGTGGTTCTTCATATGAGCTGA
CACAGCCACTCTCAGTGTCAGTGGC
CCTGGGACAGACGGCCAGGATTAC
CTGTGGGGAAACAACATTGGAAG
TAAAAATGTGCACTGGTACCAGCA
GAAGCCAGGCCAGGCCCCTGTGCT
GGCCATCTATAGGAATAGCAACCG
GCCCTCTGGGATCCCTGAGCGATTC
ACTGGCTCCAACTCGGGGAACACG
GCCACCCTGACCATCAGCAGAGCC
CAAGCCGGGGATGAGTCTGACTAT
TACTGTCAAATATGGGACAGCAGC
ACTGTGGTATTCGGCGGAGGCACC
AAGCTGACCGTCCTA |
| 1176 | MPK20298-B9_SCFV | CAGGTGCAGCTGGTGGAGTCCGGG
GGAGGCGTGGTCCAGCCTGGGAGG
TCCCTGAGACTCTCCTGTGCAGCCT
CTGGATTCAACTTCAGTAGGAATGG
CATGCACTGGGTCCGCCAGGTTCCA
GGCAGGGGGCTAGATTGGGTGGCA
GTTATATCAAATGATGGAAGTAAT
AAATACTATGCGGACTCCGTGAAG
GGCCGATTCACCATCTCCAGAGAC
AATTCCAAGAACACGCTGTATCTGC
AAATGAACAGCCTGAGAGCTGAGG
ACACGGCTGTGTATTACTGTGCGAA
AGTTTACTATGGTTCGGGTATTTAT
TATAAAAAGAACTACTACTACGGT
ATGGACGTCTGGGGCCAAGGGACC
ACGGTCACCGTCTCCTCAGGTGGTG
GTGGTTCTGGCGGCGGCGGCTCCG
GTGGTGGTGGTTCTTCATATGAGCT
GACTCAGCCACCCTCGGTGTCAGTG
GCCCTGGGACAGACGGCCAGGATT
TCCTGTGGGGAAACAACATTGGA
AGTAAAAATGTGCACTGGTACCAG
CAGAAGCCAGGCCAGGCCCCTGTG
CTGGTCATCTATAGGGATAGCAACC
GGCCCTCTGGGATCCCTGAGCGATT
CTCTGGCTCCAAGTCGGGGACCAC
GGCCACCCTGACCATCAGCAGAGC
CCAAGCCGGGGATGAGGCTGAGTA
TTACTGTCAGGTGTGGGACAGCAG
CACTGTGGTTTTCGGCGGAGGCACC
CAGCTGACCGTCCTA |
| 1177 | MPK20299-E2_SCFV | CAGGTGCAGCTGGTGGAGTCCGGG
GGAGGCGTGGTCCAGCCTGGGAGG
TCCCTGAGACTCTCCTGTGCAGTCT
CTGGATTCAACTTCAGTAACAATGG
CATGCACTGGGTCCGCCAGGCTCCA
GGCAAGGGGCTGGAGTGGGTGGCA
GTCATATCGTATGATGGAAGTAATA
AATACTATACAGACTCCGTGAAGG
GCCGATTCACCATCTCCAGAGACA
ATTCCAAGAACACGCTGTATCTGCA
AATGAACAGCCTGAGAACTGAGGA
CACGGCTGTGTATTACTGTGCGAAA
GTTTACTATGGTTCGGGTATTTATT
ATAAAAAGAGATACTACTACGGTA
TGGACGTCTGGGGCCAAGGGACCA
CGGTCACCGTCTCCTCAGGTGGTGG
TGGTTCTGGCGGCGGCGGCTCCGGT
GGTGGTGGTTCTTCATATGAGCTGA
CTCAGCCACCCTCAGTGTCAGTGGC
CCTGGGACAGACGGCCAGGATTAC
CTGTGAGGGAAACAACATTGGAAG
TCAAAATGTGCACTGGTACCAGCA
GAAGCCAGGCCAGGCCCCTGTGCT
GGTCATGTATAGGGATAGCAACCG
GCCCTCTGGGATCCCTGAACGATTC
TCTGGCTCCAAGTCGGGGAACACG
GCCACCCTGGCCATCAGCAGAGCC |

TABLE 20-continued

Amino acid sequences.

| SEQ ID NO: | Designation | Sequence |
|---|---|---|
| | | CAAGCCGGGGATGAGTCTGACTAT<br>TACTGTCAGGTGTGGGACGGCAGT<br>GCCGTGGTATTCGGCGGAGGGACC<br>AAGCTGACCGTCCTA |
| 1178 | MPK20299-D6_SCFV | CAGGTGCAGCTGGTGGAGTCTGGG<br>GGAGGCGTGGTCCAGCCTGGGAGG<br>TCCCTGAGACTCTCCTGTGCAGCGT<br>CTGGATTCACCTTCAGTAGCTATGG<br>CATGCACTGGGTCCGCCAGGCTCCA<br>GGCAAGGGGCTGGAGTGGGTGGCA<br>GTTATATCATATGATGGAAGTAATA<br>AATATTATGCAGACTCCGTGAAGG<br>GCCGATTCACCATCTCCAGAGACA<br>ATTCCAAGAACACGCTGTATCTACA<br>AATGAACAGCCTGAGAGCTGAGGA<br>CACGGCTGTGTATTTCTGTGCGAGA<br>GTTTACTATGGTTCGGGGATTTATT<br>ATAAAAAGAGATACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACTCTCAGTGTCAGTGGC<br>CCTGGGACAGACGGCCAGGATTAC<br>CTGTGAGGGAAACAACATTGGAAG<br>TCAAAATGTGCACTGGTACCAGCA<br>GAAGCCAGGCCAGGCCCCTGTGCT<br>GGTCATGTATAGGGATAGCAACCG<br>GCCCTCTGGGATCCCTGAACGATTC<br>TCTGGCTCCAAGTCGGGGAACACG<br>GCCACCCTGGCCATCAGCAGAGCC<br>CAAGCCGGGGATGAGTCTGACTAT<br>TACTGTCAGGTGTGGGACGGCAGT<br>GCCGTGGTATTCGGCGGAGGCACC<br>CAGCTGACCGTCCTA |
| 1179 | MPK20299-A4_SCFV | CAGGTGCAGCTGGTGGAGTCCGGG<br>GGAGGCGTGGTCCAGCCTGGGAGG<br>TCCCTGAGACTCTCCTGTGCAGCGT<br>CTGGATTCACCTTCAGTAACTATGG<br>CTTTCACTGGGTCCGCCAGACTCCA<br>GGCAAGGGGCTGGAGTGGGTGGCA<br>GTTATATCATATGATGGAAGTAATA<br>GATACTATGCAGACTCCGTGAAGG<br>GCCGATTCACCATCTCCAGAGACA<br>ATTCCAAGAACACGCTGTATCTCCA<br>AATGAACAGCCTGAGAGGTGAGGA<br>CACGGCGCTATATTACTGTGCGAGA<br>GTTTACTATGGTTCGGGGACTTATT<br>ATAAAAACCGCTACTACTACGGTAT<br>GGACGTCTGGGGCCAAGGGACCAC<br>GGTCACCGTCTCCTCAGGTGGTGGT<br>GGTTCTGGCGGCGGCGGCTCCGGT<br>GGTGGTGGTTCTTCATATGAGCTGA<br>CTCAGCCACCCTCAGTGTCAGTGGC<br>CCTGGGACAGACGGCCAGGATTAC<br>CTGTGGGGACACAACATTGGAAG<br>TAAAGGTGTGCACTGGTACCAGCA<br>GAAGCCAGGCCAGGCCCCTGTACT<br>GGTCATCTATAGAAATAGCAACCG<br>GCCCTCTGGGATCCCTGAGCGATTC<br>TCTGGCTCCAACTCTGGGAACACAG<br>CCACTCTGACCATCAGCGGGACCC<br>AGGCTATGGATGAGGCTGACTATT<br>ACTGTCAGGCGTGGGACAGCGGCA<br>CTGTGGTATTCGGCGGAGGCACCC<br>AGCTGACCGTCCTA |
| 1180 | MPK20300-G5_SCFV | CAGGTGCAGCTGGTGGAGTCCGGG<br>GGAGGCGTGGTCCAGCCTGGGAGG<br>TCCCTGAGACTCTCCTGTGCAGCCT<br>CTGGATTCACCTTCAGTAACTATGG<br>CTTTCACTGGGTCCGCCAGACTCCA<br>GGCAAGGGGCTGGAGTGGGTGGCA |

TABLE 20-continued

Amino acid sequences.

| SEQ ID NO: | Designation | Sequence |
|---|---|---|
| | | GTTATATCATATGATGGAAGTAATA<br>GATACTATGCAGACTCCGTGAAGG<br>GCCGATTCACCATCTCCAGAGACA<br>ATTCCAAGAACACGCTGTATCTCCA<br>AATGAACAGCCTGAGAGGTGAGGA<br>CACGGCGCTATATTACTGTGCGAGA<br>GTTTACTATGGTTCGGGGACTTATT<br>ATAAAAACCGCTACTACTACGGTAT<br>GGACGTCTGGGGCCAAGGGACCAC<br>GGTCACCGTCTCCTCAGGTGGTGGT<br>GGTTCTGGCGGCGGCGGCTCCGGT<br>GGTGGTGGTTCTTCATATGAGCTGA<br>CTCAGCCACCCTCAGTGTCAGTGGC<br>CCTGGGACAGACGGCCAGGATTAC<br>CTGTGGGGCAAACAACATTGGAAG<br>TAAAAATGTTCACTGGTACCAGCA<br>GAAGCCAGGCCAGCCCCCTGTGCT<br>GGTCATCTATAGAGATTTCAACCGG<br>CCCTCTGGGATCCCTGAGCGATTCT<br>CTGCCTCCAACTCGGGGAACACGG<br>CCACCCTGACCATCAGCAGAGGCC<br>AAGCCGGGGATGAGGCTGACTATT<br>ACTGTCAGGTGTGGGACAGCAGCA<br>CTGGGAATGTGGTATTCGGCGGAG<br>GGACCAAGCTGACCGTCCTA |
| 1181 | MPK20299-C3_SCFV | CAGGTGCAGCTGGTGGAGTCTGGG<br>GGAGGCGTGGTCCAGCCTGGGAGG<br>TCCCTGAGACTCTCCTGTGCAGCCT<br>CTGGATTCATCTTCAGTAACTATGG<br>CTTTCACTGGGTCCGCCAGACTCCA<br>GGCAAGGGGCTGGAGTGGGTGGCA<br>GTTATATCATATGATGGAAGTAATA<br>AATACTATGCAGACTCCGTGAAGG<br>GCCGATTCACCATCTCCAGAGACA<br>ATTCCAAGAACACGCTGTATCTGCA<br>AATGAACAGCCTGAGAGGTGAGGA<br>CACGGCGGTGTATTACTGTGCGAG<br>AGTTTACTATGGTTCGGGGAGTTAT<br>TATAAAAACCGCTACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCGGTGTCAGTGGC<br>CCCAGGACAGACGGCCAGGATTAC<br>CTGTGGGGGAAACAACATTGGAAG<br>TAAAAATGTGCACTGGTACCAGCA<br>GAAGCCAGGCCAGGCCCCTGTGCT<br>GGTCATCTATAGGGATAGCAACCG<br>GCCCTCTGGGATCCCTGAGCGATTC<br>TCTGGCTCCAAGTCGGGGACCACG<br>GCCACCCTGACCATCAGCAGAGCC<br>CAAGCCGGGGATGAGGCTGACTAT<br>TACTGTCAGGTGTGGGACAGCAGC<br>ACTGTGGTTTTCGGCGGAGGGACC<br>GAGCTGACCGTCCTA |
| 1182 | MPK20299-B7_SCFV | CAGGTGCAGCTGGTGGAGTCTGGG<br>GGAGGCGTGGTCCAGCCTGGGAGG<br>TCCCTGAGACTCTCCTGTGCAGCCT<br>CTGGATTCAACTTCAGTAACTATGG<br>CATGCACTGGGTCCGCCAGGCTCCA<br>GGCAAGGGGCTGGAATGGGTGGCA<br>GTTATATCATATGATGGAAGTAATA<br>AATATTATGCAGACTCCGTGAAGG<br>GCCGATTCACCATCTCCAGAGACA<br>ATTCCAAGAACACGCTGTATCTACA<br>AATGAACAGCCTGAGAGGTGAGGA<br>CACGGCTGTGTATTTCTGTGCGAGA<br>GTTTACTATGGTTCGGGGATTTATT<br>ATAAAAAGAGATACTACTACGGTA<br>TGGACGTCTGGGGCCAAGGGACCA<br>CGGTCACCGTCTCCTCAGGTGGTGG<br>TGGTTCTGGCGGCGGCGGCTCCGGT |

TABLE 20-continued

Amino acid sequences.

| SEQ ID NO: | Designation | Sequence |
|---|---|---|
| | | GGTGGTGGTTCTTCATATGAGCTGA CTCAGTCATCCTCGGTGTCAGTGGC CCCAGGACAGACGGCCAGGATTAC CTGTGGGGAAACAACATTGGAAG TAAAAATGTGCACTGGTACCAGCA GAAGCCAGGCCAGGCCCCTGTGTT GGTCATCTATAGGGATAGCAACCG GCCCTCTGGGATCCCTGAGCGATTC TCTGGCTCCAAGTCGGGGACCACG GCCACCCTGACCATCAGCAGGGTC GAAGCCGGGGATGAGGCCGACTAT TACTGTCAGGTGTGGGATAGTAGTA GTGCTCATGTGATATTCGGCGGAGG GACCAAGCTGACCGTCCTA |
| 1183 | MPK20299-A5_SCFV | CAGGTGCAGCTGGTGGAGTCCGGG GGAGGCGTGGTCCAGCCTGGGAGG TCCCTGAGACTCTCCTGTGGAGCCT CTGGATTCACCTTCAGTGGCTATGG CATGCACTGGGTCCGCCAGGCTCCA GGCAAGGGGCTGGAGTGGGTGGCA GTTATATCATATGATGGAAGTAATA AATACTATGCAGACTCCGTGAAGG GCCGATTCACCATCTCAAGAGACA ATTCCAAGAACACGCTGTATCTGCA AATGAACAGCCTGAGAGGTGAGGA CACGGCGGTGTATTACTGTGCGAG AGTTTATTATGGTTCGGGGATTTAT TATAAAAACCGCTACTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCAGGGTCAGTGGC CCTGGGACAGACGGCCAGGATCAC CTGTGGGGAAACAACCTTGGAAG TAAAAATGTGCACTGGTACCAACA GAAGCCAGGCCAGGCCCCTGTGCT GGTCATCTATAGAAATAGCAACCG GCCCTCTGGGATCCCTGAGCGATTC TCTGGCTCCAACTCGGGGAACACG GCCACCCTGACCATCAGCAGAGCC CAGGCCGGGGATGAGGCTGACTAT TACTGTCAGGTGTGGGACAGCAGC ACTGTGGTATTCGGCGGTGGGACC AAGCTGACCGTCCTA |
| 1184 | MPK20299-D1_SCFV | CAGGTGCAGCTGGTGGAGTCTGGG GGAGGCCTGGTCAAGCCTGGGGGG TCCCTGAGACTCTCCTGTGCAGCCT CTGGATTCACCTTCAGTAACAATGG CATGCACTGGGTCCGCCAGGCTCCA GGCAAGGGGCTGGAGTGGGTGGCA GTCATATCGTATGATGGAAGTAATA AATACTATGCGGACTCCGTGAAGG GCCGATTCACCATCTCCAGAGACA ATTCCAAGAACACGCTGTATCTGCA AATGAACAGCCTGAGAGCTGAGGA CACGGCTGTGTATTACTGTGCGAAA GTTTATTATGGTTCGGGGATTTATT ATAAAAACAGGTATTACTACGGGA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCAGTGTCAGTGGC CCTGGGACAGACGGCCAGGATTAC CTGTGGGGAAACAGAATTGGAAG TAAAAATGTGCACTGGTACCAGCA GAAGCCAGGCCAGGCCCCTGTGTT GGTCATCTATAGGGATAGCAACCG GCCCTCTGGGATCCCTGAGCGATTC TCTGGCTCCAAGTCGGGGACCACG GCCACCCTGACCATCAGCAGAGCC CAAGCCGGGGATGAGGCTGAGTAT |

TABLE 20-continued

Amino acid sequences.

| SEQ ID NO: | Designation | Sequence |
|---|---|---|
| | | TACTGTCAGGTGTGGGACAGCAGC ACTGTGGTTTTCGGCGGAGGGACC AAGCTGACCGTCCTA |
| 1185 | MPK20299-C5_SCFV | CAGGTGCAGCTGGTGGAGTCTGGG GGAGGCGTGGTCCAGCCTGGGAGG TCCCTGAGACTCTCCTGTGCAGCCT CTGGATTCACCTTCAGTAACTATGG CTTTCACTGGGTCCGCCAGACTCCA GGCAAGGGGCTGGAGTGGGTGGCA GTTATATCATATGATGGAAGTAATA GATACTATGCAGACTCCGTGAAGG GCCGATTCACCATCTCCAGAGACA ATTCCAAGAACACGCTGTATCTGCA AATGAACAGCCTGAGAGGTGAGGA CACGGCGCTATATTACTGTGCGAGA GTTTACTATGGTTCGGGGACTTATT ATAAAAACCGCTACTACTACGGTAT GGACGTCTGGGGCCAAGGGACCAC GGTCACCGTCTCCTCAGGTGGTGGT GGTTCTGGCGGCGGCGGCTCCGGT GGTGGTGGTTCTTCATATGAGCTGA CACAGCTACCTTCAGTGTCAGTGGC CCTGGGACAGACGGCCAGGATTAC CTGTGGGGACACAACATTGGAAG TAAAGGTGTGCACTGGTACCAGCA GAAGCCAGGCCAGGCCCCTGTGCT GGTCATCTATAGAAATAGCAACCG GCCCTCTGGGATCCCTGAGCGATTC TCTGGCTCCAACTCGGGGAACACG GCCACCCTGACCATCAGCAGAGCC CAAGCCGGGGATGAGGCTGACTAT TACTGTCAGGTGTGGGACAGCAGC ACTGTGGTTTTCGGCGGAGGGACC GAGCTGACCGTCCTA |
| 1186 | MPK20299-B5_SCFV | CAGGTGCAGCTGGTGGAGTCTGGG GGAGGCGTGGTCCAGCCTGGGAGG TCCCTGAGACTCTCCTGTGCAGCCT CTGGATTCAACTTCAGTAACTATGG CATGCACTGGGTCCGCCAGGCTCCA GGCAAGGGGCTGGAATGGGTGGCA GTTATATCATATGATGGAAGTAATA AATATTATGCAGACTCCGTGAAGG GCCGATTCACCATCTCCAGAGACA ATTCCAAGAACACGCTGTATCTACA AATGAACAGCCTGAGAGCTGAGGA CACGGCTGTGTATTTCTGTGCGAGA GTTTACTATGGTTCGGGGATTTATT ATAAAAACCGCTATTACTACGGTAT GGACGTCTGGGGCCAAGGGACCAC GGTCACCGTCTCCTCAGGTGGTGGT GGTTCTGGCGGCGGCGGCTCCGGT GGTGGTGGTTCTTCATATGAGCTGA CTCAGCCACCCTCAGTGTCAGTGGC CCTGGGACAGACGGCCAGGATTAC CTGTGGGGACACAACATTGGAAG TAAAGGTGTGCACTGGTACCAGCA GAAGCCAGGCCAGGCCCCTGTGCT GGTCATCTATAGAAATAGCAACCG GCCCTCTGGGATCCCTGAGCGATTC TCTGGCTCCAACTCGGGGAACACG GCCACCCTGACCATCAGCAGAGCC CAAGCCGGGGATGAGGCTGACTAT TACTGTCAGGTGTGGGACAGTAGT ACTGTGGTTTTCGGCGGAGGCACCC AGCTGACCGTCCTA |
| 1187 | MPK20299-G9_SCFV | CAGGTGCAGCTGGTGGAGTCTGGG GGAGACTTGGTACAGCCTGGGAGG TCCCTGAGACTCTCCTGTGCAGCGT CTGGATTCACCTTCAGTAACAATGG CATGCACTGGGTCCGCCAGGCTCCA GGCAAGGGACTGGAGTGGGTGGCA GTTATTTCAAATGATGGCAGTAATA |

TABLE 20-continued

Amino acid sequences.

| SEQ ID NO: | Designation | Sequence |
|---|---|---|
| | | AATATTATGCAGATTCCGTGAGGG<br>GCCGATTCACCATCTCCAGAGACA<br>ATTCCAAGAACACGCTGTATCTGCA<br>AATGAACAGCCTGAGAGCTGAGGA<br>CACGGCTGTGTATTATTGTGCGAAA<br>GTTTACTATGGTTCGGGTATTTATT<br>ATAAAAACAGGTACTACTACGGGA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACTCTCAGTGTCAGTGGC<br>CCTGGGACAGACGGCCAGGATTAC<br>CTGTGGGGAAACAACATTGGAAG<br>TAAAAATGTGCACTGGTACCAGCA<br>GAAGCCAGGCCAGGCCCCTGTGCT<br>GGTCATCTATAGGAATAGCAACCG<br>GCCCTCTGGGATCCCTGAGCGATTC<br>TCTGGCTCCAACTCGGGGAACACG<br>GCCACCCTGACTCTTAGCAGAGTCC<br>AAGCCGGGGATGAGGCTGACTATT<br>ACTGTCAGGTGTGGGACAGCAGCA<br>CTGTGGTTTTCGGCGGAGGGACCA<br>AGCTGACCGTCCTA |
| 1188 | MPK20299-G5_SCFV | CAGGTGCAGCTGGTGGAGTCCGGG<br>GGAGGCGTGGTCCAGCCTGGGAGG<br>TCCCTGAGACTCTCCTGTGCAGTCT<br>CTGGATTCAACTTCAGTAACAATGG<br>CATGCACTGGGTCCGCCAGGCTCCA<br>GGCAAGGGACTGGAGTGGGTGGCA<br>GTTATTTCAAATGATGGCAGTAATA<br>AATATTATGCAGATTCCGTGAGGG<br>GCCGATTCACCATCTCCAGAGACA<br>ATTCCAAGAACACACTGTATCTGCA<br>AATGGACAGCCTGAGAACTGAGGA<br>CACGGCTGTGTATTACTGTGCGAAA<br>GTTTACTATGGTTCGGGTATTTATT<br>ATAAAAACAGGTACTACTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA<br>CTCAGCCACCCTCAGTGTCAGTGGC<br>CCTGGGACAGACGGCCAGGCTTAC<br>CTGTGAGGGAAACAACATTGGAAG<br>TAAAAATGTGCACTGGTACCAGCA<br>GAAGCCAGGCCAGGCCCCTGTGTT<br>GGTCATCTATAGGGATAGCAACCG<br>GCCCTCTGGGATCCCTGAGCGCTTC<br>TCTGGCTCCAAGTCGGGGAACACG<br>GCCACCCTGGCCATCAGCAGAGCC<br>CAAGCCGGGGATGAGTCTGACTAT<br>TACTGTCAGGTGTGGGACAGCAGT<br>GCCGTGGTATTCGGCGGAGGCACC<br>AAGCTGACCGTCCTA |
| 1189 | MPK20298-C10_SCFV | CAGGTGCAGCTGGTGGAGTCCGGG<br>GGAGGCGTGGTCCAGCCTGGGAGG<br>TCCCTGAGACTCTCCTGTGCAGCCT<br>CTGGATTCACCTTCAGTAGCTCTGG<br>CATGCACTGGGTCCGCCAGGCTCCA<br>GGCAAGGGGCTGGAGTGGGTGGCA<br>GTTATATCAAATGATGGAAGTAAT<br>AAATACTATGCAGACTCCGTGAAG<br>GGCCGATTCACCATCTCCAGAGAC<br>AATTCCAAGAACACGCTGTATCTGC<br>AAATGAACAGCCTGAGAGCTGAGG<br>ACACGGCTGTGTATTACTGTGCGAA<br>AGTTTACTATGGTTCGGGGATTTAT<br>TATAAAAATAACTACTATTACGGTA<br>TGGACGTCTGGGGCCAAGGGACCA<br>CGGTCACCGTCTCCTCAGGTGGTGG<br>TGGTTCTGGCGGCGGCGGCTCCGGT<br>GGTGGTGGTTCTTCATATGAGCTGA |

TABLE 20-continued

Amino acid sequences.

| SEQ ID NO: | Designation | Sequence |
|---|---|---|
| | | CTCAGCCACCCTCAGTGTCAGTGGC
CCTGGGACAGACGGCCAGGATTAC
CTGTGGGGGAAACAACATTGGAAG
TAAAAATGTGCACTGGTACCAGCA
GAAGCCAGGCCAGGCCCCTGTGCT
GGCCATCTATAGGAATAGCAACCG
GCCCTCTGGGATCCCTGAGCGATTC
ACTGGCTCCAACTCGGGGAACACG
GCCACCCTGACCATCAGCGGGACC
CAGGCTATGGATGAGGCTGACTATT
ACTGTCAGGCGTGGGACAGCAGCA
CTGTGGTATTCGGCGGAGGGACCA
AGCTGACCGTCCTA |
| 1190 | MPK20298-B5_SCFV | CAGGTGCAGCTGGTGGAGTCTGGG
GGAGGCGTGGTCCAGCCTGGGAGG
TCCCTGAGACTCTCCTGTGCAGCCT
CTGGATTCAACTTCAGTAACTATGG
CATGCACTGGGTCCGCCAGGCTCCA
GGCAAGGGGCTGGAATGGGTGGCA
GTTATATCATATGATGGAAGTAATA
AATATTATGCAGACTCCGTGAAGG
GCCGATTCACCATCTCCAGAGACA
ATTCCAAGAACACGCTGTATCTACA
AATGAACAGCCTGAGAGCTGAGGA
CACGGCTGTGTATTCTGTGCGAGA
GTTTACTATGGTTCGGGGATTTATT
ATAAAAAGAGATACTACTACGGTA
TGGACGTCTGGGGCCAAGGGACCA
CGGTCACCGTCTCCTCAGGTGGTGG
TGGTTCTGGCGGCGGCGGCTCCGGT
GGTGGTGGTTCTTCATATGAGCTGA
CTCAGCCACCCTCAGTGTCAGTGGC
CCTGGGACAGACGGCCAGGATTAC
CTGTGGGGGAAACAACATTGGAAG
TCAAAATGTGCACTGGTACCAGCA
GAAGCCAGGCCAGGCCCCTGTGCT
GGTCATCTATAGGGATAGCAACCG
GCCCTCTGGGATCCCTGAGCGCTTC
TCTGGCTCCAAGTCGGGGAACACG
GCCACCCTGGCCATCAGCAGAGCC
CAAGCCGGGGATGAGTCTGACTAT
TACTGTCAGGTGTGGGACAGCAGT
GCCGTGGTATTCGGCGGAGGCACC
CAGCTGACCGTCCTA |
| 1191 | MPK20299-F2_SCFV | CAGGTGCAGCTGGTGGAGTCCGGG
GGAGGCGTGGTCCAGCCTGGGAGG
TCCCTGAGACTCTCCTGTGCAGCCT
CTGGATTCACCCTCAGTAGCTCTGG
CATGCACTGGGTCCGCCAGGCTCCA
GGCAAGGGGCTGGAGTGGGTGGCA
GTTATATCAAATGATGGAAGTAAT
AAATACTATGCGGACTCCGTGAAG
GGCCGGTTCACCATCTCCAGAGAC
GATTCCAAGAACACACTGTATCTGC
AAATGGACAGCCTGAGAACTGAGG
ACACGGCTGTGTATTACTGTGCGAA
AGTTTACTATGGTTCGGGTATTTAT
TATAAAAACAGGTACTACTACGGG
ATGGACGTCTGGGGCCAAGGGACC
ACGGTCACCGTCTCCTCAGGTGGTG
GTGGTTCTGGCGGCGGCGGCTCCG
GTGGTGGTGGTTCTTCATATGAGCT
GACTCAGCCACCCTCAGTGTCAGTG
GCCCTGGGACAGACGGCCAGGATT
CCTGTGGGGGAAACAACATTGGA
AGTAAAAATGTGCACTGGTACCAG
CAGAAGCCAGGCCAGGCCCCTGTG
CTGGTCATGTATAGGGATAGCAAC
CGGCCCTCAGGGATCCCTGAGCGA
TTCTCTGGCTCCAACTCTGGGAACA
CAGCCACTCTGACCATCAGCGGGA
CCCAGGCTATGGATGAGGCTGACT
ATTACTGTCAGGCGTGGGACAGCG |

TABLE 20-continued

Amino acid sequences.

| SEQ ID NO: | Designation | Sequence |
|---|---|---|
| | | GCACTGTGGTATTCGGCGGAGGGA CCAAGCTGACCGTCCTA |
| 1192 | MPK20298-D4_SCFV | CAGGTGCAGCTGGTGGAGTCTGGG GGAGGCGTGGTCCAGCCTGGGAGG TCCCTGAGACTCTCCTGTGCAGCCT CTGGATTCAACTTCAGTAACTATGG CATGCACTGGGTCCGCCAGGCTCCA GGCAAGGGGCTGGAATGGGTGGCA GTTATATCATATGATGGAAGTAATA AATATTATGCAGACTCCGTGAAGG GCCGATTCACCATCTCCAGAGACA ATTCCAAGAACACGCTGTATCTACA AATGAACAGCCTGAGAGCTGAGGA CACGGCTGTGTATTCTGTGCGAGA GTTTACTATGGTTCGGGGATTTATT ATAAAAAGAGATACTACTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACCCTCAGTGTCAGTGGC CCTGGGACAGACGGCCAGAATTAC CTGTGGGGAAACAACATTGGAGG TAAAAATGTGCACTGGTACCAGCA GAAGCCAGGCCAGGCCCCTGTGCT GGTCATCTATAGGGATAGCAACCG GCCCTCTGGGATCCCTGAGCGATTC TCTGGCTCCAAGTCGGGGAACACG GCCACCCTGACCATCAGCAGAGCC CAAGCCGGGGATGAGTCTGACTAT TACTGTCAGGTGTGGGACAGCAGC ACTGTGGTATTCGGCGGAGGCACC CAGCTGACCGTCCTA |
| 1193 | MPK20297-F5_SCFV | CAGGTGCAGCTGGTGGAGTCTGGG GGAGGCGTGGTCCAGCCTGGGAGG TCCCTGAGACTCTCCTGTGTAGTCT CTGGATTCAACTTCAGTAGGAATGG CATGCACTGGGTCCGCCAGGTTCCA GGCAGGGGGCTAGATTGGGTGGCA GTTATATCAAATGATGGAAGTAAT AAATACTATGCAGACTCCGTGAAG GGCCGATTCACCATCTCCAGAGAC AATTCCAAGAACACGCTGTATCTGC AAATGAACAGCCTGAGAGCTGAGG ACACGGCTGTGTATTACTGTGCGAA AGTTTACTATGGTTCGGGGATTTAT TATAAAAATAACTACTATTACGGTA TGGACGTCTGGGGCCAAGGGACCA CGGTCACCGTCTCCTCAGGTGGTGG TGGTTCTGGCGGCGGCGGCTCCGGT GGTGGTGGTTCTTCATATGAGCTGA CTCAGCCACTCTCAGTGTCAGTGGC CCTGGGACAGACGGCCAGGATTAC CTGTGGGGAAACAACATTGGAAG TAAAAATGTGCACTGGTACCAGCA GAAGCCAGGCCAGGCCCCTGTGCT GGTCATCTATAGAAATAGCAACCG GCCCTCTGGGATCCCTGAGCGATTC TCTGGCTCCAACTCGGGGAACACG GCCACCCTGACCATCAGCAGAGCC CAGGCCGGGGATGAGGCTGACTAT TACTGTCAGGTGTGGGACAGCAGC ACTGTGGTTTTCGGCGGTGGGACCA AGCTGACCGTCCTA |
| 1194 | MPK20299-D9_SCFV | CAGGTGCAGCTGGTGGAGTCCGGG GGAGGCTTGGTCAAGCCTGGAGGG TCCCTGAGACTCTCCTGTGCAGCCT CTGGATTCAACTTCAGTAGGAATGG CATGCACTGGGTCCGCCAGGTTCCA GGCAGGGGGCTAGATTGGGTGGCA GTTATATCAAATGATGGAAGTAAT AAATACTATGCAGACTCCGTGAAG |

TABLE 20-continued

Amino acid sequences.

| SEQ ID NO: | Designation | Sequence |
|---|---|---|
| | | GGCCGATTCACCATCTCCAGAGAC
AATTCCAAGAACACGCTGTATCTGC
AAATGAACAGCCTGAGAGCTGAGG
ACACGGCTGTGTATTACTGTGCGAA
AGTTTACTATGGTTCGGGGATTTAT
TATAAAAATAACTACTACTACGGTA
TGGACGTCTGGGGCCAAGGGACCA
CGGTCACCGTCTCCTCAGGTGGTGG
TGGTTCTGGCGGCGGCGGCTCCGGT
GGTGGTGGTTCTTCATATGAGCTGA
CTCAGCCACCCTCAGTGTCAGTGGC
CCTGGGACAGACGGCCAGGATTTC
CTGTGGGGAAACAACATTGAAAG
TAAAAATGTGCACTGGTACCAGCA
GAAGCCAGGCCAGGCCCCTGTGTT
GGTCATCTATAGGGATAGCAACCG
GCCCTCTGGGATCCCTGAGCGATTC
TCTGGCTCCAAGTCGGGGACCACG
GCCACCCTGACCATCAGCAGAGCC
CAAGCCGGGGATGAGGCTGAGTAT
TACTGTCAGGTGTGGGACAGCAGC
ACTGTGGTTTTCGGCGGAGGCACCC
AGCTGACCGTCCTA |
| 1195 | huCCR8_32360_huIgG1z mAb(LC:K38R)_HC | ATGGACATGAGGGTGCCCGCTCAG
CTCCTGGGGCTCCTGCTGCTGTGGC
TGAGAGGTGCGCGCTGTGAGGTGC
AGCTGGTGGAGTCTGGGGGAGGCT
TGGTAAAGCCTGGGGGGTCCCTGA
GACTCTCCTGTGCAGCCTCTGGATT
TACTTTCAGTAACGCCCGGATGGGC
TGGGTCCGCCAGGCTCCAGGGAAG
GGGCTGGAGTGGGTTGGCCGTATT
AAAAGCAAAACTGAAGGTGGACA
AGAGACTACGCTGCACCCGTGAAA
GGCAGATTCACCATCTCAAGAGAT
GATTCAAAAAACACGCTGTATCTGC
AAATGAACAGCCTGAAAACCGAGG
ACACAGCCGTGTATTATTGTACCTC
GTATAGTGGGGTCTGGGGCCAAGG
GACAATGGTCACCGTGTCTTCAGCC
TCCACCAAGGGCCCATCGGTCTTCC
CCCTGGCACCCTCCTCCAAGAGCAC
CTCTGGGGGCACAGCGGCCCTGGG
CTGCCTGGTCAAGGACTACTTCCCC
GAACCGGTGACGGTGTCGTGGAAC
TCAGGCGCCCTGACCAGCGGCGTG
CACACCTTCCCGGCTGTCCTACAGT
CCTCAGGACTCTACTCCCTCAGCAG
CGTGGTGACCGTGCCCTCCAGCAGC
TTGGGCACCCAGACCTACATCTGCA
ACGTGAATCACAAGCCCAGCAACA
CCAAGGTGGACAAGAAAGTTGAGC
CCAAATCTTGTGACAAAACTCACAC
ATGCCCACCGTGCCCAGCACCTGA
ACTCCTGGGGGGACCGTCAGTCTTC
CTCTTCCCCCCAAAACCCAAGGACA
CCCTCATGATCTCCCGGACCCCTGA
GGTCACATGCGTGGTGGTGGACGT
GAGCCACGAAGACCCTGAGGTCAA
GTTCAACTGGTACGTGGACGGCGT
GGAGGTGCATAATGCCAAGACAAA
GCCGCGGGAGGAGCAGTACAACAG
CACGTACCGTGTGGTCAGCGTCCTC
ACCGTCCTGCACCAGGACTGGCTG
AATGGCAAGGAGTACAAGTGCAAG
GTGTCCAACAAAGCCCTCCCAGCCC
CCATCGAGAAAACCATCTCCAAAG
CCAAAGGGCAGCCCCGAGAACCAC
AGGTGTACACCCTGCCCCCATCCCG
GGAGGAGATGACCAAGAACCAGGT
CAGCCTGACCTGCCTGGTCAAAGG
CTTCTATCCCAGCGACATCGCCGTG
GAGTGGGAGAGCAATGGGCAGCCG
GAGAACAACTACAAGACCACGCCT |

TABLE 20-continued

Amino acid sequences.

| SEQ ID NO: | Designation | Sequence |
|---|---|---|
| | | CCCGTGCTGGACTCCGACGGCTCCT TCTTCCTCTATAGCAAGCTCACCGT GGACAAGAGCAGGTGGCAGCAGGG GAACGTCTTCTCATGCTCCGTGATG CATGAGGCTCTGCACAACCACTAC ACGCAGAAGAGCCTCTCCCTGTCTC CGGGCAAATAG |
| 1196 | huCCR8_32360_huIgG1z mAb(LC:K38R)_LC | ATGGACATGAGGGTGCCCGCTCAG CTCCTGGGGCTCCTGCTGCTGTGGC TGAGAGGTGCGCGCTGTGACATCG TGATGACCCAGTCTCCAGACTCCCT GGCTGTGTCTCTGGGCGAGAGGGC CACCATCAACTGCAAGTCCAGCCA GAGTGTTTTATACAGTTCCAACAAT AGAAACTACTTAGCTTGGTACCATC AGAAACCAGGACAGTCTCCTAAGC TGCTCATTTCCTGGGCATCTACCCG GGAATCCGGGGTCCCTGACCGATTC AGTGGCAGCGGGTCTGGGACAGAT TTCACTCTCACCATCAACAGCCTGC AGGCTGAAGATGTGGCAGTTTATTA CTGTCAACAATATTATAGTATTCCG ATCACTTTCGGCGGAGGGACCAAG GTGGAGATCAAACGAACGGTGGCT GCACCATCTGTCTTCATCTTCCCGC CATCTGATGAGCAGTTGAAATCTGG AACTGCCTCTGTTGTGTGCCTGCTG AATAACTTCTATCCCAGAGAGGCC AAAGTACAGTGGAAGGTGGATAAC GCCCTCCAATCGGGTAACTCCCAGG AGAGTGTCACAGAGCAGGACAGCA AGGACAGCACCTACAGCCTCAGCA GCACCCTGACGCTGAGCAAAGCAG ACTACGAGAAACACAAAGTCTACG CCTGCGAAGTCACCCATCAGGGCCT GAGCTCGCCCGTCACAAAGAGCTT CAACAGGGGAGAGTGTTAG |
| 1197 | anti-huCCR8_44379(VH:D72S, VL:N67A_S68A_M99G_W109F_S111A)_huIgG1z (mAb)_HC | ATGGACATGAGGGTGCCCGCTCAG CTCCTGGGGCTCCTGCTGCTGTGGC TGAGAGGTGCGCGCTGTCAGGTGC AGCTGGTGGAGTCCGGGGGAGGCG TGGTCCAGCCTGGGAGGTCCCTGA GACTCTCCTGTGCAGCCTCTGGATT CACCTTCAGTAACTATGGCTTTCAC TGGGTCCGCCAGACTCCAGGCAAG GGGCTGGAGTGGGTGGCAGTTATC TCATATGATGGAAGTAATAGATACT ATGCAAGCTCCGTGAAGGGCCGAT TCACCATCTCCAGAGACAATTCCAA GAACACGCTGTATCTCCAAATGAA CAGCCTGAGAGGTGAGGACACGGC GCTATATTACTGTGCGAGAGTTTAC TATGGTTCGGGGACTTATTATAAAA ACCGCTACTACACGGTATGGACGT CTGGGGCCAAGGGACCACGGTCAC CGTGTCCTCAGCCTCCACCAAGGGC CCATCGGTCTTCCCCCTGGCACCCT CCTCCAAGAGCACCTCTGGGGGCA CAGCGGCCCTGGGCTGCCTGGTCA AGGACTACTTCCCCGAACCGGTGA CGGTGTCGTGGAACTCAGGCGCCCT GACCAGCGGCGTGCACACCTTCCC GGCTGTCCTACAGTCCTCAGGACTC TACTCCCTCAGCAGCGTGGTGACCG TGCCCTCCAGCAGCTTGGGCACCCA GACCTACATCTGCAACGTGAATCAC AAGCCCAGCAACACCAAGGTGGAC AAGAAAGTTGAGCCCAAATCTTGT GACAAAACTCACACATGCCCACCG TGCCCAGCACCTGAACTCCTGGGG GGACCGTCAGTCTTCCTCTTCCCCC CAAAACCCAAGGACACCCTCATGA TCTCCCGGACCCCTGAGGTCACATG |

TABLE 20-continued

Amino acid sequences.

| SEQ ID NO: | Designation | Sequence |
|---|---|---|
| | | CGTGGTGGTGGACGTGAGCCACGA AGACCCTGAGGTCAAGTTCAACTG GTACGTGGACGGCGTGGAGGTGCA TAATGCCAAGACAAAGCCGCGGGA GGAGCAGTACAACAGCACGTACCG TGTGGTCAGCGTCCTCACCGTCCTG CACCAGGACTGGCTGAATGGCAAG GAGTACAAGTGCAAGGTGTCCAAC AAAGCCCTCCCAGCCCCCATCGAG AAAACCATCTCCAAAGCCAAAGGG CAGCCCCGAGAACCACAGGTGTAC ACCCTGCCCCCATCCCGGGAGGAG ATGACCAAGAACCAGGTCAGCCTG ACCTGCCTGGTCAAAGGCTTCTATC CCAGCGACATCGCCGTGGAGTGGG AGAGCAATGGGCAGCCGGAGAACA ACTACAAGACCACGCCTCCCGTGCT GGACTCCGACGGCTCCTTCTTCCTC TATAGCAAGCTCACCGTGGACAAG AGCAGGTGGCAGCAGGGGAACGTC TTCTCATGCTCCGTGATGCATGAGG CTCTGCACAACCACTACACGCAGA AGAGCCTCTCCCTGTCTCCGGGCAA ATAG |
| 1198 | anti-huCCR8_44379(VH:D72S, VL:N67A_S68A_M99G_W109F_S111A)_huIgG1z (mAb)_LC | ATGGCCTGGGCTCTGCTGCTCCTCA CCCTCCTCACTCAGGGCACAGGGTC CTGGGCCTCATATGAGCTGACTCAG CCACCCTCAGTGTCAGTGGCCCTGG GACAGACGGCCAGGATTACCTGTG GGGGACACAACATTGGAAGTAAAG GTGTGCACTGGTACCAGCAGAAGC CAGGCCAGGCCCCTGTACTGGTCAT CTATAGAGCCGCCAACCGGCCCTCT GGGATCCCTGAGCGATTCTCTGGCT CCAACTCTGGGAACACAGCCACTCT GACCATCAGCGGGACCCAGGCTGG CGATGAGGCTGACTATTACTGTCAG GCGTTCGACGCCGGCACTGTGGTAT TCGGCGGAGGCACCCAGCTGACCG TCCTAGGTCAGCCCAAGGCTGCACC CTCGGTCACTCTGTTCCCGCCCTCC TCTGAGGAGCTTCAAGCCAACAAG GCCACACTGGTGTGTCTCATCAGTG ACTTCTACCCGGGAGCCGTGACAGT GGCCTGGAAGGCAGATAGCAGCCC CGTCAAGGCGGGAGTGGAAACCAC CACACCCTCCAAACAAAGCAACAA CAAGTACGCGGCCAGCAGCTATCT GAGCCTGACGCCTGAGCAGTGGAA GTCCCACAGAAGCTACAGCTGCCA GGTCACGCATGAAGGGAGCACCGT GGAGAAGACAGTGGCCCCTACAGA ATGTTCATAG |
| 1199 | anti-huCCR8_44379(VH:D61A_D72A, VL:N67Q_M99E_W109F_S111A)_huIgG1z (mAb)_HC | ATGGACATGAGGGTGCCCGCTCAG CTCCTGGGGCTCCTGCTGCTGTGGC TGAGAGGTGCGCGCTGTCAGGTGC AGCTGGTGGAGTCCGGGGGAGGCG TGGTCCAGCCTGGGAGGTCCCTGA GACTCTCCTGTGCAGCCTCTGGATT CACCTTCAGTAACTATGGCTTTCAC TGGGTCCGCCAGACTCCAGGCAAG GGGCTGGAGTGGGTGGCAGTTATC TCATATGCCGGAAGTAATAGATACT ATGCAGCCTCCGTGAAGGGCCGAT TCACCATCTCCAGAGACAATTCCAA GAACACGCTGTATCTCCAAATGAA CAGCCTGAGAGGTGAGGACACGGC GCTATATTACTGTGCGAGAGTTTAC TATGGTTCGGGGACTTATTATAAAA ACCGCTACTACTACGGTATGGACGT CTGGGGCCAAGGGACCACGGTCAC CGTGTCCTCAGCCTCCACCAAGGGC CCATCGGTCTTCCCCCTGGCACCCT |

TABLE 20-continued

Amino acid sequences.

| SEQ ID NO: | Designation | Sequence |
|---|---|---|
| | | CCTCCAAGAGCACCTCTGGGGGCA CAGCGGCCCTGGGCTGCCTGGTCA AGGACTACTTCCCCGAACCGGTGA CGGTGTCGTGGAACTCAGGCGCCCT GACCAGCGGCGTGCACACCTTCCC GGCTGTCCTACAGTCCTCAGGACTC TACTCCCTCAGCAGCGTGGTGACCG TGCCCTCCAGCAGCTTGGGCACCCA GACCTACATCTGCAACGTGAATCAC AAGCCCAGCAACACCAAGGTGGAC AAGAAAGTTGAGCCCAAATCTTGT GACAAAACTCACACATGCCCACCG TGCCCAGCACCTGAACTCCTGGGG GGACCGTCAGTCTTCCTCTTCCCCC CAAAACCCAAGGACACCCTCATGA TCTCCCGGACCCCTGAGGTCACATG CGTGGTGGTGGACGTGAGCCACGA AGACCCTGAGGTCAAGTTCAACTG GTACGTGGACGGCGTGGAGGTGCA TAATGCCAAGACAAAGCCGCGGGA GGAGCAGTACAACAGCACGTACCG TGTGGTCAGCGTCCTCACCGTCCTG CACCAGGACTGGCTGAATGGCAAG GAGTACAAGTGCAAGGTGTCCAAC AAAGCCCTCCCAGCCCCCATCGAG AAAACCATCTCCAAAGCCAAAGGG CAGCCCCGAGAACCACAGGTGTAC ACCCTGCCCCCATCCCGGGAGGAG ATGACCAAGAACCAGGTCAGCCTG ACCTGCCTGGTCAAAGGCTTCTATC CCAGCGACATCGCCGTGGAGTGGG AGAGCAATGGGCAGCCGGAGAACA ACTACAAGACCACGCCTCCCGTGCT GGACTCCGACGGCTCCTTCTTCCTC TATAGCAAGCTCACCGTGGACAAG AGCAGGTGGCAGCAGGGGAACGTC TTCTCATGCTCCGTGATGCATGAGG CTCTGCACAACCACTACACGCAGA AGAGCCTCTCCCTGTCTCCGGGCAA ATAG |
| 1200 | anti-huCCR8_44379(VH:D61A_D72A, VL:N67Q_M99E_W109F_S111A)_huIgG1z (mAb)_LC | ATGGCCTGGGCTCTGCTGCTCCTCA CCCTCCTCACTCAGGGCACAGGGTC CTGGGCCTCATATGAGCTGACTCAG CCACCCTCAGTGTCAGTGGCCCTGG GACAGACGGCCAGGATTACCTGTG GGGGACACAACATTGGAAGTAAAG GTGTGCACTGGTACCAGCAGAAGC CAGGCCAGGCCCCTGTACTGGTCAT CTATAGACAGAGCAACCGGCCCTC TGGGATCCCTGAGCGATTCTCTGGC TCCAACTCTGGGAACACAGCCACTC TGACCATCAGCGGGACCCAGGCTG AAGATGAGGCTGACTATTACTGTCA GGCGTTCGACGCCGGCACTGTGGT ATTCGGCGGAGGCACCCAGCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1201 | anti-huCCR8_44379(VH:D61S, VL:N67Q_M99G_W109F_S111A)_huIgG1z (mAb)_HC | ATGGACATGAGGGTGCCCGCTCAG CTCCTGGGGCTCCTGCTGCTGTGGC TGAGAGGTGCGCGCTGTCAGGTGC AGCTGGTGGAGTCCGGGGGAGGCG |

TABLE 20-continued

Amino acid sequences.

| SEQ ID NO: | Designation | Sequence |
|---|---|---|
| | | TGGTCCAGCCTGGGAGGTCCCTGA<br>GACTCTCCTGTGCAGCCTCTGGATT<br>CACCTTCAGTAACTATGGCTTTCAC<br>TGGGTCCGCCAGACTCCAGGCAAG<br>GGGCTGGAGTGGGTGGCAGTTATC<br>TCATATAGCGGAAGTAATAGATAC<br>TATGCAGACTCCGTGAAGGGCCGA<br>TTCACCATCTCCAGAGACAATTCCA<br>AGAACACGCTGTATCTCCAAATGA<br>ACAGCCTGAGAGGTGAGGACACGG<br>CGCTATATTACTGTGCGAGAGTTTA<br>CTATGGTTCGGGGACTTATTATAAA<br>AACCGCTACTACTACGGTATGGAC<br>GTCTGGGGCCAAGGGACCACGGTC<br>ACCGTGTCCTCAGCCTCCACCAAGG<br>GCCCATCGGTCTTCCCCCTGGCACC<br>CTCCTCCAAGAGCACCTCTGGGGGC<br>ACAGCGGCCCTGGGCTGCCTGGTC<br>AAGGACTACTTCCCCGAACCGGTG<br>ACGGTGTCGTGGAACTCAGGCGCC<br>CTGACCAGCGGCGTGCACACCTTCC<br>CGGCTGTCCTACAGTCCTCAGGACT<br>CTACTCCCTCAGCAGCGTGGTGACC<br>GTGCCCTCCAGCAGCTTGGGCACCC<br>AGACCTACATCTGCAACGTGAATC<br>ACAAGCCCAGCAACACCAAGGTGG<br>ACAAGAAAGTTGAGCCCAAATCTT<br>GTGACAAAACTCACACATGCCCAC<br>CGTGCCCAGCACCTGAACTCCTGGG<br>GGGACCGTCAGTCTTCCTCTTCCCC<br>CCAAAACCCAAGGACACCCTCATG<br>ATCTCCCGGACCCCTGAGGTCACAT<br>GCGTGGTGGTGGACGTGAGCCACG<br>AAGACCCTGAGGTCAAGTTCAACT<br>GGTACGTGGACGGCGTGGAGGTGC<br>ATAATGCCAAGACAAAGCCGCGGG<br>AGGAGCAGTACAACAGCACGTACC<br>GTGTGGTCAGCGTCCTCACCGTCCT<br>GCACCAGGACTGGCTGAATGGCAA<br>GGAGTACAAGTGCAAGGTGTCCAA<br>CAAAGCCCTCCCAGCCCCCATCGA<br>GAAAACCATCTCCAAAGCCAAAGG<br>GCAGCCCCGAGAACCACAGGTGTA<br>CACCCTGCCCCCATCCCGGGAGGA<br>GATGACCAAGAACCAGGTCAGCCT<br>GACCTGCCTGGTCAAAGGCTTCTAT<br>CCCAGCGACATCGCCGTGGAGTGG<br>GAGAGCAATGGGCAGCCGGAGAAC<br>AACTACAAGACCACGCCTCCCGTG<br>CTGGACTCCGACGGCTCCTTCTTCC<br>TCTATAGCAAGCTCACCGTGGACA<br>AGAGCAGGTGGCAGCAGGGGAACG<br>TCTTCTCATGCTCCGTGATGCATGA<br>GGCTCTGCACAACCACTACACGCA<br>GAAGAGCCTCTCCCTGTCTCCGGGC<br>AAATAG |
| 1202 | anti-huCCR8_44379(VH:D61S, VL:N67Q_M99G_W109F_S111A)_huIgG1z (mAb)_LC | ATGGCCTGGGCTCTGCTGCTCCTCA<br>CCCTCCTCACTCAGGGCACAGGGTC<br>CTGGGCCTCATATGAGCTGACTCAG<br>CCACCCTCAGTGTCAGTGGCCCTGG<br>GACAGACGGCCAGGATTACCTGTG<br>GGGGACACAACATTGGAAGTAAAG<br>GTGTGCACTGGTACCAGCAGAAGC<br>CAGGCCAGGCCCCTGTACTGGTCAT<br>CTATAGACAGAGCAACCGGCCCTC<br>TGGGATCCCTGAGCGATTCTCTGGC<br>TCCAACTCTGGGAACACAGCCACTC<br>TGACCATCAGCGGGACCCAGGCTG<br>GCGATGAGGCTGACTATTACTGTCA<br>GGCGTTCGACGCCGGCACTGTGGT<br>ATTCGGCGGAGGCACCCAGCTGAC<br>CGTCCTAGGTCAGCCCAAGGCTGC<br>ACCCTCGGTCACTCTGTTCCCGCCC<br>TCCTCTGAGGAGCTTCAAGCCAACA |

TABLE 20-continued

Amino acid sequences.

| SEQ ID NO: | Designation | Sequence |
|---|---|---|
| | | AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1203 | Hu anti-huCCR8 LIBC315615-1 HuIgG1z mAb_LC | ATGGCCTGGGCTCTGCTGCTCCTCA CCCTCCTCACTCAGGGCACAGGGTC CTGGGCCTCCTATGAACTGACTCAG CCACTCTCAGTGTCAGTGGCCCTGG GACAGACGGCCAGGATTACCTGTG GGGGACACAACATTGGAAGTAAAG GTGTGCACTGGTACCAGCAGAAGC CAGGCCAGGCCCCTGTGCTGGTCAT CTATAGAAATAGCAACCGGCCCTCT GGGATCCCTGAGCGATTCTCTGGCT CCAACTCGGGGAACACGGCCACCC TGACCATCAGCAGAGCCCAAGCCG GGGATGAGGCTGACTATTACTGTCA GGTGTGGGACATCAGCACTGTGGTT TTCGGCGGAGGGACCGAGCTGACC GTCCTAGGTCAGCCCAAGGCTGCA CCCTCGGTCACTCTGTTCCCGCCCT CCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1204 | Hu anti-huCCR8 LIBC315615-1 HuIgG1z mAb_HC | ATGGACATGAGGGTGCCCGCTCAG CTCCTGGGGCTCCTGCTGCTGTGGC TGAGAGGTGCGCGCTGTCAGGTGC AGCTGGTGGAGTCTGGGGGAGGCG TGGCCCAGCCTGGGAGGTCCCTGA GACTCTCCTGTGCAGCCTCTGGATT CAACTTCAGTAACTGTGGCATGCAC TGGGTCCGCCAGGCTCCAGGCAAG GGGCTGGAGTGGGTGGCAGTTATA TCATATGATGGAGGTAATAAATATC ATGCGGACTCCGTGAAGGGCCGGT TCACCATCTCCAGAGACGATTCCAA GAACACACTGTATCTGCAAATGGA CAGCCTGAGAACTGAGGACACGGC TGTGTATTACTGTGCGAAAGTTTAC TATGGTTCGGGTATTTATTATAAAA ACAGGTACTACTACGGGATGGACG TCtGGGGCCAAGGGACCACGGTCAC CGTCTCCTCAGCCTCCACCAAGGGC CCATCGGTCTTCCCCCTGGCACCCT CCTCCAAGAGCACCTCTGGGGGCA CAGCGGCCCTGGGCTGCCTGGTCA AGGACTACTTCCCCGAACCGGTGA CGGTGTCGTGGAACTCAGGCGCCCT GACCAGCGGCGTGCACACCTTCCC GGCTGTCCTACAGTCCTCAGGACTC TACTCCCTCAGCAGCGTGGTGACCG TGCCCTCCAGCAGCTTGGGCACCCA GACCTACATCTGCAACGTGAATCAC AAGCCCAGCAACACCAAGGTGGAC AAGAAAGTTGAGCCCAAATCTTGT GACAAAACTCACACATGCCCACCG TGCCCAGCACCTGAACTCCTGGGG |

TABLE 20-continued

Amino acid sequences.

| SEQ ID NO: | Designation | Sequence |
|---|---|---|
| | | GGACCGTCAGTCTTCCTCTTCCCCC
CAAAACCCAAGGACACCCTCATGA
TCTCCCGGACCCCTGAGGTCACATG
CGTGGTGGTGGACGTGAGCCACGA
AGACCCTGAGGTCAAGTTCAACTG
GTACGTGGACGGCGTGGAGGTGCA
TAATGCCAAGACAAAGCCGCGGGA
GGAGCAGTACAACAGCACGTACCG
TGTGGTCAGCGTCCTCACCGTCCTG
CACCAGGACTGGCTGAATGGCAAG
GAGTACAAGTGCAAGGTGTCCAAC
AAAGCCCTCCCAGCCCCCATCGAG
AAAACCATCTCCAAAGCCAAAGGG
CAGCCCCGAGAACCACAGGTGTAC
ACCCTGCCCCCATCCCGGGAGGAG
ATGACCAAGAACCAGGTCAGCCTG
ACCTGCCTGGTCAAAGGCTTCTATC
CCAGCGACATCGCCGTGGAGTGGG
AGAGCAATGGGCAGCCGGAGAACA
ACTACAAGACCACGCCTCCCGTGCT
GGACTCCGACGGCTCCTTCTTCCTC
TATAGCAAGCTCACCGTGGACAAG
AGCAGGTGGCAGCAGGGGAACGTC
TTCTCATGCTCCGTGATGCATGAGG
CTCTGCACAACCACTACACGCAGA
AGAGCCTCTCCCTGTCTCCGGGCAA
ATAG |
| 1205 | Hu anti-huCCR8 LIBC317152-1 HuIgG1z mAb_LC | ATGGCCTGGGCTCTGCTGCTCCTCA
CCCTCCTCACTCAGGGCACAGGGTC
CTGGGCCTCCTATGAGCTGACTCAG
CCACTCTCAGTGTCAGTGGCCCTGG
GACAGACGGCCAGGATTACCTGTG
GGGGACACAACATTGGAAGTAAAG
GTGTGCACTGGTACCAGCAGAAGC
CAGGCCAGGCCCCTGTGCTGGTCAT
CTATAGAAATAGCAACCGGCCCTCT
GGGATCCCTGAGCGATTCTCTGGCT
CCAACTCGGGGAAAACGGCCACCC
TGACCATCAGCAGAGCCCAAGCCG
GGGATGAGGCTGACTATTACTGTCA
GGTGTGGGACAGCAGCACTGTGGT
TTTCGGCGGAGGGACCGAGCTGAC
CGTCCTAGGTCAGCCCAAGGCTGC
ACCCTCGGTCACTCTGTTCCCGCCC
TCCTCTGAGGAGCTTCAAGCCAACA
AGGCCACACTGGTGTGTCTCATCAG
TGACTTCTACCCGGGAGCCGTGACA
GTGGCCTGGAAGGCAGATAGCAGC
CCCGTCAAGGCGGGAGTGGAAACC
ACCACACCCTCCAAACAAAGCAAC
AACAAGTACGCGGCCAGCAGCTAT
CTGAGCCTGACGCCTGAGCAGTGG
AAGTCCCACAGAAGCTACAGCTGC
CAGGTCACGCATGAAGGGAGCACC
GTGGAGAAGACAGTGGCCCCTACA
GAATGTTCATAG |
| 1206 | Hu anti-huCCR8 LIBC317152-1 HuIgG1z mAb_HC | ATGGACATGAGGGTGCCCGCTCAG
CTCCTGGGGCTCCTGCTGCTGTGGC
TGAGAGGTGCGCGCTGTCAGGTGC
AGCTGGTGGAGTCTGGGGGAGGCG
TGGCCCAGCCTGGGAGGTCCCTGA
GACTCTCCTGTGCAGCCTCTGGATT
CAACTTCAGTAACTGTGGCATGCAC
TGGGTCCGCCAGGCTCCAGGCAAG
GGGCTGGAGTGGGTGGCAGTTATA
TCATATGATGGAGGTAATAAATATT
ATGCGGACTCCGTGAAGGGCCGGT
TCACCATCTCCAGAGACGATTCCAA
GAACACACTGTATCTGCAAATGGA
CAGCCTGAGAACTGAGGACACGGC
TGTGTATTACTGTGCGAAAGTTTAC
TATGGTTCGGGTATTTATTATAAAA
ACAGGTATTACTACGGGATGGACG |

TABLE 20-continued

Amino acid sequences.

| SEQ ID NO: | Designation | Sequence |
|---|---|---|
| | | TCTGGGGCCAAGGGACCACGGTCA CCGTCTCCTCAGCCTCCACCAAGGG CCCATCGGTCTTCCCCCTGGCACCC TCCTCCAAGAGCACCTCTGGGGGC ACAGCGGCCCTGGGCTGCCTGGTC AAGGACTACTTCCCCGAACCGGTG ACGGTGTCGTGGAACTCAGGCGCC CTGACCAGCGGCGTGCACACCTTCC CGGCTGTCCTACAGTCCTCAGGACT CTACTCCCTCAGCAGCGTGGTGACC GTGCCCTCCAGCAGCTTGGGCACCC AGACCTACATCTGCAACGTGAATC ACAAGCCCAGCAACACCAAGGTGG ACAAGAAAGTTGAGCCCAAATCTT GTGACAAAACTCACACATGCCCAC CGTGCCCAGCACCTGAACTCCTGGG GGGACCGTCAGTCTTCCTCTTCCCC CCAAAACCCAAGGACACCCTCATG ATCTCCCGGACCCCTGAGGTCACAT GCGTGGTGGTGGACGTGAGCCACG AAGACCCTGAGGTCAAGTTCAACT GGTACGTGGACGGCGTGGAGGTGC ATAATGCCAAGACAAAGCCGCGGG AGGAGCAGTACAACAGCACGTACC GTGTGGTCAGCGTCCTCACCGTCCT GCACCAGGACTGGCTGAATGGCAA GGAGTACAAGTGCAAGGTGTCCAA CAAAGCCCTCCCAGCCCCCATCGA GAAAACCATCTCCAAAGCCAAAGG GCAGCCCCGAGAACCACAGGTGTA CACCCTGCCCCCATCCCGGGAGGA GATGACCAAGAACCAGGTCAGCCT GACCTGCCTGGTCAAAGGCTTCTAT CCCAGCGACATCGCCGTGGAGTGG GAGAGCAATGGGCAGCCGGAGAAC AACTACAAGACCACGCCTCCCGTG CTGGACTCCGACGGCTCCTTCTTCC TCTATAGCAAGCTCACCGTGGACA AGAGCAGGTGGCAGCAGGGGAACG TCTTCTCATGCTCCGTGATGCATGA GGCTCTGCACAACCACTACACGCA GAAGAGCCTCTCCCTGTCTCCGGGC AAATAG |
| 1207 | Hu anti-huCCR8 LIBC317471-1 HuIgG1z mAb_LC | ATGGCCTGGGCTCTGCTGCTCCTCA CCCTCCTCACTCAGGGCACAGGGTC CTGGGCCTCCTATGAGCTGACTCAG CCACTCTCAGTGTCAGTGGCCCTGG GACAGACGGCCAGGATTACCTGTG GGGGAAACAACATTGGAAGTAAAA ATGTGCACTGGTACCAGAAGAGGC CAGGCCAGGCCCCTGTGCTGGTCAT CTATAGGGATAGCAACCGGCCCTCT GGGATCCCTGAGCGATTCTCTGGCT CCAAGTCGGGGAACACGGCCACCC TGACCATCAGCAGAGCCCAAGCCG GGGATGAGGCTGACTATTACTGTCA GGTGTGGGACAGCAACACTGTGGT TTTCGGCGGAGGGACCAACCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |

TABLE 20-continued

Amino acid sequences.

| SEQ ID NO: | Designation | Sequence |
|---|---|---|
| 1208 | Hu anti-huCCR8 LIBC317471-1 HuIgG1z mAb_HC | ATGGACATGAGGGTGCCCGCTCAGCTCCTGGGGCTCCTGCTGCTGTGCTGAGAGGTGCGCGCTGTCAGGTGCAGCTGGTGGAGTCTGGGGGAGGCGTGGTCCAGCCTGGGAGGTCCCTGAGACTCTCCTGTGTAGTCTCTGGATTCAACTTCAGTAACAATGGCATGCACTGGGTCCGCCAGGCTCCAGGCAAGGGACTGGAGTGGGTGGCAGTTATTTCAAATGATGGCAGTAATAAATATTATGCAGATTCCGTGAGGGGCCGATTCACCATCTCCAGAGACAATTCCAAGAACACGCTGTATCTGCAAATGAACAGCCTGAGAGCTGAGGACACGGCTGTGTATTCCTGTGCGAAAGTTTACTATGGTTCGGGAATTTATTACAAAAATAACTACTACTACGGTATGGACGTCTGGGGCCAAGGGACCACGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG |
| 1209 | Hu anti-huCCR8 LIBC317977-1 HuIgG1z mAb_LC | ATGGCCTGGGCTCTGCTGCTCCTCACCCTCCTCACTCAGGGCACAGGGTCCTGGGCCTcctATGAGCTGACTCAGCCACTCTCAGTGTCAGTGGCCCTGGGACAGACGGCCAGGATTACCTGTGGGGGAAACAACATTGGAAGTAAAAATGTGCACTGGTACCAGCAGAAGGCAGGCCAGGCCCCTGTGCAGGTCATCTATAGAAATAGCAACCGGCCCTCTGGGATCCCTGAGCGATTCTCTGGCTCCAACTCGGGGAACACGGCCACCCTGACCATCAGCAGAGCCCAGGCCGGGATGAGGCTGACTATTACTGTCA |

TABLE 20-continued

Amino acid sequences.

| SEQ ID NO: | Designation | Sequence |
|---|---|---|
| | | GGTGTGGGACAGCAGCACTGTGGT TTTCGGCGGTGGGACCAAGCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1210 | Hu anti-huCCR8 LIBC317977-1 HuIgG1z mAb_HC | ATGGACATGAGGGTGCCCGCTCAG CTCCTGGGGCTCCTGCTGCTGTGGC TGAGAGGTGCGCGCTGTCAGGTGC AGCTGGTGGAGTCTGGGGGAGGCG TGGTCCAGCCTGGGAGGTCCCTGA GACTCTCCTGTGCAGCCTCTGGATT CAACTTCAATACCTATGGCATGCAC TGGGTCCGCCAGGCTCCAGGCAAG GGGCTGGAGTGGGTGGCAGTTATA TCATATGATGGAAGTAATAAATATT ATGCAGACTCCGTGAAGGGCCGAT TCACCATCTCCAGAGACAATTCCAA GAGCACGCTGTATCTGCAAATGAA CAGCCTGAGAGCTGAGGACACGGC TGTGTATTACTGTGCGAGAGTTTAC TATGGTTCGGGGAGTTATTATAAAA AGAATTACTACTACGGTATGGACGT CTGGGGCCAAGGGACCACGGTCAC CGTCTCCTCAGCCTCCACCAAGGGC CCATCGGTCTTCCCCCTGGCACCCT CCTCCAAGAGCACCTCTGGGGGCA CAGCGGCCCTGGGCTGCCTGGTCA AGGACTACTTCCCCGAACCGGTGA CGGTGTCGTGGAACTCAGGCGCCCT GACCAGCGGCGTGCACACCTTCCC GGCTGTCCTACAGTCCTCAGGACTC TACTCCCTCAGCAGCGTGGTGACCG TGCCCTCCAGCAGCTTGGGCACCCA GACCTACATCTGCAACGTGAATCAC AAGCCCAGCAACACCAAGGTGGAC AAGAAAGTTGAGCCCAAATCTTGT GACAAAACTCACACATGCCCACCG TGCCCAGCACCTGAACTCCTGGGG GGACCGTCAGTCTTCCTCTTCCCCC CAAAACCCAAGGACACCCTCATGA TCTCCCGGACCCCTGAGGTCACATG CGTGGTGGTGGACGTGAGCCACGA AGACCCTGAGGTCAAGTTCAACTG GTACGTGGACGGCGTGGAGGTGCA TAATGCCAAGACAAAGCCGCGGGA GGAGCAGTACAACAGCACGTACCG TGTGGTCAGCGTCCTCACCGTCCTG CACCAGGACTGGCTGAATGGCAAG GAGTACAAGTGCAAGGTGTCCAAC AAAGCCCTCCCAGCCCCCATCGAG AAAACCATCTCCAAAGCCAAAGGG CAGCCCCGAGAACCACAGGTGTAC ACCCTGCCCCCATCCCGGGAGGAG ATGACCAAGAACCAGGTCAGCCTG ACCTGCCTGGTCAAAGGCTTCTATC CCAGCGACATCGCCGTGGAGTGGG AGAGCAATGGGCAGCCGGAGAACA ACTACAAGACCACGCCTCCCGTGCT GGACTCCGACGGCTCCTTCTTCCTC TATAGCAAGCTCACCGTGGACAAG AGCAGGTGGCAGCAGGGGAACGTC TTCTCATGCTCCGTGATGCATGAGG CTCTGCACAACCACTACACGCAGA |

TABLE 20-continued

Amino acid sequences.

| SEQ ID NO: | Designation | Sequence |
|---|---|---|
| | | AGAGCCTCTCCCTGTCTCCGGGCAAATAG |
| 1211 | Hu anti-huCCR8 LIBC318774-1 HuIgG1z mAb_LC | ATGGCCTGGGCTCTGCTGCTCCTCACCCTCCTCACTCAGGGCACAGGGTCCTGGGCCTCCTATGAGCTGACTCAGCCACTCTCAGTGTCAGTGGCCCTGGGACAGACGGCCAGGATTACCTGTGGGGGAAACAACATTGGAGGTAAAAATGTGCACTGGTACCAGCAGAAGCCAGGCCAGGCCCCTGTGCTGGTCATCTATAGGGATAGCAACCGGCCCTCTGGGATCCCTGAGCGATTCTCTGGCTCCAAGTCGGGGAACACGGCCACCCTGACCATCAGCAGAGCCCAAGCCGGGGATGAGTCTGACTATTACTGTCAGGTTTGGGACAGCAGCACTGTGGTATTCGGCGGAGGGACCACGCTGACCGTCCTAGGTCAGCCCAAGGCTGCACCCTCGGTCACTCTGTTCCCGCCCTCCTCTGAGGAGCTTCAAGCCAACAAGGCCACACTGGTGTGTCTCATCAGTGACTTCTACCCGGGAGCCGTGACAGTGGCCTGGAAGGCAGATAGCAGCCCCGTCAAGGCGGGAGTGGAAACCACCACACCCTCCAAACAAAGCAACAACAAGTACGCGGCCAGCAGCTATCTGAGCCTGACGCCTGAGCAGTGGAAGTCCCACAGAAGCTACAGCTGCCAGGTCACGCATGAAGGGAGCACCGTGGAGAAGACAGTGGCCCCTACAGAATGTTCATAG |
| 1212 | Hu anti-huCCR8 LIBC318774-1 HuIgG1z mAb_HC | ATGGACATGAGGGTGCCCGCTCAGCTCCTGGGGCTCCTGCTGCTGTGGCTGAGAGGTGCGCGCTGTCAGGTGCAGGTGGTGGAGTCTGGGGGAGGCGTGGTCCAGCCTGGGAGGTCCCTGAGACTCTCCTGTGCAGCCTCTGGATTCACCCTCAGTAGTTATGGCTTTCACTGGGTCCGCCAGACTCCAGGCAAGGGGCTGGAGTGGGTGGCAGTTATATCATATGATGGAAGTAATAAATActATGCAGACTCCGTGAAGGGCCGATTCACCATCTCCAGAGACAATTCCAAGAACACGCTGTATCTCCAAATGAACAGCCTGAGAGGTGAGGACACGGCGGTGTATTACTGTGCGAGAGTTTACTATGGTTCGGGGACTTATTATAAAAACCGCTACTACTACGGTATGGACGTCTGGGGCCAAGGGACCACGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTG |

TABLE 20-continued

Amino acid sequences.

| SEQ ID NO: | Designation | Sequence |
|---|---|---|
| | | CACCAGGACTGGCTGAATGGCAAG GAGTACAAGTGCAAGGTGTCCAAC AAAGCCCTCCCAGCCCCCATCGAG AAAACCATCTCCAAAGCCAAAGGG CAGCCCCGAGAACCACAGGTGTAC ACCCTGCCCCCATCCCGGGAGGAG ATGACCAAGAACCAGGTCAGCCTG ACCTGCCTGGTCAAAGGCTTCTATC CCAGCGACATCGCCGTGGAGTGGG AGAGCAATGGGCAGCCGGAGAACA ACTACAAGACCACGCCTCCCGTGCT GGACTCCGACGGCTCCTTCTTCCTC TATAGCAAGCTCACCGTGGACAAG AGCAGGTGGCAGCAGGGGAACGTC TTCTCATGCTCCGTGATGCATGAGG CTCTGCACAACCACTACACGCAGA AGAGCCTCTCCCTGTCTCCGGGCAA ATAG |
| 1213 | Hu anti-huCCR8 LIBC319840-1 HuIgG1z mAb_LC | ATGGCCTGGGCTCTGCTGCTCCTCA CCCTCCTCACTCAGGGCACAGGGTC CTGGGCCTCCTATGAGCTGACTCAG CCACTCTCAGTGTCAGAGGCCCTGG GACAGACGGCCAGGATTACCTGTG GGGGAAACAACATTGGAAGTAAAA ATGTGCACTGGTACCAGCAGAAGC CAGGCCAGGCCCCTGTACTGGTCAT CTATAGGGATAGCAACCGGCCCTCT GGGATCCCTGAGCGATTCTCTGGCT CCAAGTCGGGGAACACGGCCACCC TGACCATCAGCAGAGCCCAAGCCG GGGATGAGGCTGACTATTACTGTCA GGTGTGGGACAGCAGCACTGTGGT TTTCGGCGGAGGGACCAAGGTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1214 | Hu anti-huCCR8 LIBC319840-1 HuIgG1z mAb_HC | ATGGACATGAGGGTGCCCGCTCAG CTCCTGGGGCTCCTGCTGCTGTGGC TGAGAGGTGCGCGCTGTCAGGTGC AGCTGGTGGAGTCTGGGGGAGGCG TGGTCCAGCCTGGGAGGTCCCTGA GACTCTCCTGTGTAGTCTCTGGATT CAACTTCATTAACAATGGCATGCAC TGGGTCCGCCAGGCTCCAGGCAAG GGGCTGGACTGGGTGGCAGTTATA TCAAATGATGGAAGTAATAAATAC TATCCAGACTCCGTGAAGGGCCGA TTCACCATCTCCAGAGACAATTCCA AGAACACGCTGTATCTGCAAATGA ACAGCCTGAGAGCTGAGGACTCGG CTGTGTATTACTGTGCGAAAGTTTA CTATGGTTCGGGAAATTATTATAAA AACAACTACTACTACGGTATGGAC GTCTGGGGCCAAGGGACCACGGTC ACCGTCTCCTCAGCCTCCACCAAGG GCCCATCGGTCTTCCCCCTGGCACC CTCCTCCAAGAGCACCTCTGGGGGC ACAGCGGCCCTGGGCTGCCTGGTC AAGGACTACTTCCCCGAACCGGTG ACGGTGTCGTGGAACTCAGGCGCC CTGACCAGCGGCGTGCACACCTTCC CGGCTGTCCTACAGTCCTCAGGACT |

TABLE 20-continued

Amino acid sequences.

| SEQ ID NO: | Designation | Sequence |
|---|---|---|
| | | CTACTCCCTCAGCAGCGTGGTGACC GTGCCCTCCAGCAGCTTGGGCACCC AGACCTACATCTGCAACGTGAATC ACAAGCCCAGCAACACCAAGGTGG ACAAGAAAGTTGAGCCCAAATCTT GTGACAAAACTCACACATGCCCAC CGTGCCCAGCACCTGAACTCCTGGG GGGACCGTCAGTCTTCCTCTTCCCC CCAAAACCCAAGGACACCCTCATG ATCTCCCGGACCCCTGAGGTCACAT GCGTGGTGGTGGACGTGAGCCACG AAGACCCTGAGGTCAAGTTCAACT GGTACGTGGACGGCGTGGAGGTGC ATAATGCCAAGACAAAGCCGCGGG AGGAGCAGTACAACAGCACGTACC GTGTGGTCAGCGTCCTCACCGTCCT GCACCAGGACTGGCTGAATGGCAA GGAGTACAAGTGCAAGGTGTCCAA CAAAGCCCTCCCAGCCCCCATCGA GAAAACCATCTCCAAAGCCAAAGG GCAGCCCCGAGAACCACAGGTGTA CACCCTGCCCCCATCCCGGGAGGA GATGACCAAGAACCAGGTCAGCCT GACCTGCCTGGTCAAAGGCTTCTAT CCCAGCGACATCGCCGTGGAGTGG GAGAGCAATGGGCAGCCGGAGAAC AACTACAAGACCACGCCTCCCGTG CTGGACTCCGACGGCTCCTTCTTCC TCTATAGCAAGCTCACCGTGGACA AGAGCAGGTGGCAGCAGGGGAACG TCTTCTCATGCTCCGTGATGCATGA GGCTCTGCACAACCACTACACGCA GAAGAGCCTCTCCCTGTCTCCGGGC AAATAG |
| 1215 | Hu anti-huCCR8 LIBC320212-1 HuIgG1z mAb_LC | ATGGCCTGGGCTCTGCTGCTCCTCA CCCTCCTCACTCAGGGCACAGGGTC CTGGGCCTCCTATGAGCTGACTCAG CCACTCTCAGTGTCAGTGGCCCTGG GACAGACGGCCAGGATTACCTGTG AGGGAAACAACATTGGAAGTCAAA ATGTGCACTGGTACCAGCAGAAGC CAGGCCAGGCCCCTGTGCTGGTCAT GTATAGGGATAGCAACCGGCCCTC TGGGATCCCTGAACGATTCTCTGGC TCCAAGTCGGGGAACACGGCCACC CTGGCCATCAGCAGAGCCCAAGCC GGGGATGAGTCTGACTATTACTGTC AGGTGTGGGACGGCAGTGCCGTGG TATTCGGCGGAGGGACCACGCTGA CCGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1216 | Hu anti-huCCR8 LIBC320212-1 HuIgG1z mAb_HC | ATGGACATGAGGGTGCCCGCTCAG CTCCTGGGGCTCCTGCTGCTGTGGC TGAGAGGTGCGCGCTGTCAGATGC AGGTGGTGGAGTCTGGGGGAGGCG TGGTCCAGCCTGGGAGGTCCCTGA GACTCTCCTGTGCAGCCTCTGGATT CACCTTCAGTAGCTCTGGCATGCAC TGGGTCCGCCAGGCTCCAGGCAAG GGCCTGGAGTGGGTGGCAGTTATA TCACATGATGGAAGTAATAAATAC |

TABLE 20-continued

Amino acid sequences.

| SEQ ID NO: | Designation | Sequence |
|---|---|---|
| | | TATGCAGACTCCGTGAAGGGCCGA
TTCACCATCTCCAGAGACAATTCCA
AGAACACGCTGTATCTGCAAATGA
ATAGCCTGGGAGGTGAGGACACGG
CGGTGTATTACTGTGCGAAAGTTTA
CTATGGTTCGGGGATTTATTATAAA
AACCGCTATTACTACGGTATGGACG
TCTGGGGCCAAGGGACCACGGTCA
TCGTCTCGTCAGCCTCCACCAAGGG
CCCATCGGTCTTCCCCCTGGCACCC
TCCTCCAAGAGCACCTCTGGGGGC
ACAGCGGCCCTGGGCTGCCTGGTC
AAGGACTACTTCCCCGAACCGGTG
ACGGTGTCGTGGAACTCAGGCGCC
CTGACCAGCGGCGTGCACACCTTCC
CGGCTGTCCTACAGTCCTCAGGACT
CTACTCCCTCAGCAGCGTGGTGACC
GTGCCCTCCAGCAGCTTGGGCACCC
AGACCTACATCTGCAACGTGAATC
ACAAGCCCAGCAACACCAAGGTGG
ACAAGAAAGTTGAGCCCAAATCTT
GTGACAAAACTCACACATGCCCAC
CGTGCCCAGCACCTGAACTCCTGGG
GGGACCGTCAGTCTTCCTCTTCCCC
CCAAAACCCAAGGACACCCTCATG
ATCTCCCGGACCCCTGAGGTCACAT
GCGTGGTGGTGGACGTGAGCCACG
AAGACCCTGAGGTCAAGTTCAACT
GGTACGTGGACGGCGTGGAGGTGC
ATAATGCCAAGACAAAGCCGCGGG
AGGAGCAGTACAACAGCACGTACC
GTGTGGTCAGCGTCCTCACCGTCCT
GCACCAGGACTGGCTGAATGGCAA
GGAGTACAAGTGCAAGGTGTCCAA
CAAAGCCCTCCCAGCCCCCATCGA
GAAAACCATCTCCAAAGCCAAAGG
GCAGCCCCGAGAACCACAGGTGTA
CACCCTGCCCCCATCCCGGGAGGA
GATGACCAAGAACCAGGTCAGCCT
GACCTGCCTGGTCAAAGGCTTCTAT
CCCAGCGACATCGCCGTGGAGTGG
GAGAGCAATGGGCAGCCGGAGAAC
AACTACAAGACCACGCCTCCCGTG
CTGGACTCCGACGGCTCCTTCTTCC
TCTATAGCAAGCTCACCGTGGACA
AGAGCAGGTGGCAGCAGGGGAACG
TCTTCTCATGCTCCGTGATGCATGA
GGCTCTGCACAACCACTACACGCA
GAAGAGCCTCTCCCTGTCTCCGGGC
AAATAG |
| 1217 | Hu anti-huCCR8 LIBC320384-1 HuIgG1z mAb_LC | ATGGCCTGGGCTCTGCTGCTCCTCA
CCCTCCTCACTCAGGGCACAGGGTC
CTGGGCCTCCTATGAGCTGACTCAG
CCACTCTCAGTGTCAGTGGCCCTGG
GACAGACGGCCAGGATTACCTGTG
GGGGACACAACATTGGAAGTAAAG
GTGTGCACTGGTACCAGCAGAAGC
CAGGCCAGGCCCCTGTGCTGGTCAT
CTATAGAAATAGCAACCGGCCCTCT
GGGATCCCTGAGCGATTCTCTGGCT
CCAACTCGGGGAACACGGCCACCC
TGACCATCAGCAGAGCCCAAGCCG
GGGATGAGGCTGACTATTACTGTCA
GGTGTGGGACAGCAGCACTGTGGT
TTTCGGCGGAGGGACCGAGCTGAC
CGTCCTAGGTCAGCCCAAGGCTGC
ACCCTCGGTCACTCTGTTCCCGCCC
TCCTCTGAGGAGCTTCAAGCCAACA
AGGCCACACTGGTGTGTCTCATCAG
TGACTTCTACCCGGGAGCCGTGACA
GTGGCCTGGAAGGCAGATAGCAGC
CCCGTCAAGGCGGGAGTGGAAACC
ACCACACCCTCCAAACAAAGCAAC
AACAAGTACGCGGCCAGCAGCTAT |

TABLE 20-continued

Amino acid sequences.

| SEQ ID NO: | Designation | Sequence |
|---|---|---|
| | | CTGAGCCTGACGCCTGAGCAGTGG<br>AAGTCCCACAGAAGCTACAGCTGC<br>CAGGTCACGCATGAAGGGAGCACC<br>GTGGAGAAGACAGTGGCCCCTACA<br>GAATGTTCATAG |
| 1218 | Hu anti-huCCR8 LIBC320384-1 HuIgG1z mAb_HC | ATGGACATGAGGGTGCCCGCTCAG<br>CTCCTGGGGCTCCTGCTGCTGTGGC<br>TGAGAGGTGCGCGCTGTCAGGTGC<br>AGctGGTGGAGtctGGGGGAGGCGTG<br>GCCCAGCCTGGGAGGTCCCTGAGA<br>CTCTCCTGTGCAGCCTCTGGATTCA<br>ACTTCAGTGattGTGGCATGCACTGG<br>GTCCGCCaggCTCCAGGCAAGGGGC<br>TGGAGTGGGTGGCAGTTATATCATA<br>TGATGGAGGTAATAAATATTATGC<br>GGACTCCGTGAAGGGCCGGTTCAC<br>CATCTCCAGAGacgATTCCAAGAAC<br>ACACTGTAtcTGCAAacggacAGCCTG<br>AGAACTGAGGACACGGCTGTGTAT<br>TACTGTGCGAAAGTTTACTATGGTT<br>CGGGTATTTATTATAAAAACAGGTA<br>CTACTACGGGATGGACGTctggggCC<br>AAGGGACCACGGTcaccgTCTCCTCA<br>GCCTCCACCAAGGGCCCATCGGTCT<br>TCCCCCTGGCACCCTCCTCCAAGAG<br>CACCTCTGGGGGCACAGCGGCCCT<br>GGGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTAC<br>AGTCCTCAGGACTCTACTCCCTCAG<br>CAGCGTGGTGACCGTGCCCTCCAGC<br>AGCTTGGGCACCCAGACCTACATCT<br>GCAACGTGAATCACAAGCCCAGCA<br>ACACCAAGGTGGACAAGAAAGTTG<br>AGCCCAAATCTTGTGACAAAACTC<br>ACACATGCCCACCGTGCCCAGCAC<br>CTGAACTCCTGGGGGGACCGTCAG<br>TCTTCCTCTTCCCCCCAAAACCCAA<br>GGACACCCTCATGATCTCCCGGACC<br>CCTGAGGTCACATGCGTGGTGGTG<br>GACGTGAGCCACGAAGACCCTGAG<br>GTCAAGTTCAACTGGTACGTGGAC<br>GGCGTGGAGGTGCATAATGCCAAG<br>ACAAAGCCGCGGGAGGAGCAGTAC<br>AACAGCACGTACCGTGTGGTCAGC<br>GTCCTCACCGTCCTGCACCAGGACT<br>GGCTGAATGGCAAGGAGTACAAGT<br>GCAAGGTGTCCAACAAAGCCCTCC<br>CAGCCCCCATCGAGAAAACCATCT<br>CCAAAGCCAAAGGGCAGCCCCGAG<br>AACCACAGGTGTACACCCTGCCCCC<br>ATCCCGGGAGGAGATGACCAAGAA<br>CCAGGTCAGCCTGACCTGCCTGGTC<br>AAAGGCTTCTATCCCAGCGACATCG<br>CCGTGGAGTGGGAGAGCAATGGGC<br>AGCCGGAGAACAACTACAAGACCA<br>CGCCTCCCGTGCTGGACTCCGACGG<br>CTCCTTCTTCCTCTATAGCAAGCTC<br>ACCGTGGACAAGAGCAGGTGGCAG<br>CAGGGGAACGTCTTCTCATGCTCCG<br>TGATGCATGAGGCTCTGCACAACC<br>ACTACACGCAGAAGAGCCTCTCCCT<br>GTCTCCGGGCAAATAG |
| 1219 | Hu anti-huCCR8 LIBC320689-1 HuIgG1z mAb_LC | ATGGCCTGGGCTCTGCTGCTCCTCA<br>CCCTCCTCACTCAGGGCACAGGGTC<br>CTGGGCCTCCTATGAGCTGACTCAG<br>CCACTCTCAGTGTCAGTGGCCCTGG<br>GACAGACGGGCAGGATTACCTGTG<br>GGGGAAACAACATTGGAAGTAAAA<br>ATGTGCACTGGTACCAGCAGAAGC<br>CAGGCCAGGCCCCTGTGCTGGTCAT<br>CTATAGGAGTAGCAACCGGCCCTCT |

TABLE 20-continued

Amino acid sequences.

| SEQ ID NO: | Designation | Sequence |
|---|---|---|
| | | GGGATCCCTGAGCGATTCTCTGGCT
CCAACTCGGGGAACACGGCCACCC
TGACCATCAGCAGAGCCCAAGCCG
GGGATGAGTCTGACTATTACTGTCA
AATATGGGACAGCAGCACTGTGGT
ATTCGGCGGAGGGACCAAGCTGAC
CGTCCTAGGTCAGCCCAAGGCTGC
ACCCTCGGTCACTCTGTTCCCGCCC
TCCTCTGAGGAGCTTCAAGCCAACA
AGGCCACACTGGTGTGTCTCATCAG
TGACTTCTACCCGGGAGCCGTGACA
GTGGCCTGGAAGGCAGATAGCAGC
CCCGTCAAGGCGGGAGTGGAAACC
ACCACACCCTCCAAACAAAGCAAC
AACAAGTACGCGGCCAGCAGCTAT
CTGAGCCTGACGCCTGAGCAGTGG
AAGTCCCACAGAAGCTACAGCTGC
CAGGTCACGCATGAAGGGAGCACC
GTGGAGAAGACAGTGGCCCCTACA
GAATGTTCATAG |
| 1220 | Hu anti-huCCR8 LIBC320689-1 HuIgG1z mAb_HC | ATGGACATGAGGGTGCCCGCTCAG
CTCCTGGGGCTCCTGCTGCTGTGGC
TGAGAGGTGCGCGCTGTCAGGTGC
AGGTGGTGGAGTCTGGGGGAGGCG
TGGTCCAGCCTGGGAGGTCCCTGA
GACTCTCCTGTGCAGCCTCTGGATT
CACCTTCAGTAGCTATGGCATGCAC
TGGGTCCGCCAGGCTCCAGGCAAG
GGGCTGGAGTGGGTGGCAGTTATA
TCATTTGATGGAAATAATAAATACT
ATGCAGACTCCGTGAAGGGCCGAT
TCACCATCTCCAGAGACAATTCCAA
GAACACGCTATATCTGCAAATGAA
CAGCCTGAGAGGTGAGGACACGGC
GGTGTATTACTGTGCGAGAGTTTAT
TATGGTTCGGGGAGTTATTATAAAA
ACCGCTACTACTACGGTATGGACGT
CTGGGGCCAAGGGACCACGGTCAC
CGTCTCCACAGCCTCCACCAAGGGC
CCATCGGTCTTCCCCCTGGCACCCT
CCTCCAAGAGCACCTCTGGGGGCA
CAGCGGCCCTGGGCTGCCTGGTCA
AGGACTACTTCCCCGAACCGGTGA
CGGTGTCGTGGAACTCAGGCGCCCT
GACCAGCGGCGTGCACACCTTCCC
GGCTGTCCTACAGTCCTCAGGACTC
TACTCCCTCAGCAGCGTGGTGACCG
TGCCCTCCAGCAGCTTGGGCACCCA
GACCTACATCTGCAACGTGAATCAC
AAGCCCAGCAACACCAAGGTGGAC
AAGAAAGTTGAGCCCAAATCTTGT
GACAAAACTCACACATGCCCACCG
TGCCCAGCACCTGAACTCCTGGGG
GGACCGTCAGTCTTCCTCTTCCCCC
CAAAACCCAAGGACACCCTCATGA
TCTCCCGGACCCCTGAGGTCACATG
CGTGGTGGTGGACGTGAGCCACGA
AGACCCTGAGGTCAAGTTCAACTG
GTACGTGGACGGCGTGGAGGTGCA
TAATGCCAAGACAAAGCCGCGGGA
GGAGCAGTACAACAGCACGTACCG
TGTGGTCAGCGTCCTCACCGTCCTG
CACCAGGACTGGCTGAATGGCAAG
GAGTACAAGTGCAAGGTGTCCAAC
AAAGCCCTCCCAGCCCCCATCGAG
AAAACCATCTCCAAAGCCAAAGGG
CAGCCCCGAGAACCACAGGTGTAC
ACCCTGCCCCCATCCCGGGAGGAG
ATGACCAAGAACCAGGTCAGCCTG
ACCTGCCTGGTCAAAGGCTTCTATC
CCAGCGACATCGCCGTGGAGTGGG
AGAGCAATGGGCAGCCGGAGAACA
ACTACAAGACCACGCCTCCCGTGCT
GGACTCCGACGGCTCCTTCTTCCTC |

TABLE 20-continued

Amino acid sequences.

| SEQ ID NO: | Designation | Sequence |
|---|---|---|
| | | TATAGCAAGCTCACCGTGGACAAG AGCAGGTGGCAGCAGGGGAACGTC TTCTCATGCTCCGTGATGCATGAGG CTCTGCACAACCACTACACGCAGA AGAGCCTCTCCCTGTCTCCGGGCAA ATAG |
| 1221 | Hu anti-huCCR8 LIBC321408-1 HuIgG1z mAb_LC | ATGGCCTGGGCTCTGCTGCTCCTCA CCCTCCTCACTCAGGGCACAGGGTC CTGGGCCTCCTATGAACTGACTCAG CCACTCTCAGTGTCAGTGGCCCTGG GACAGACGGCCAGGATTACCTGTG GGGGAAACAACATTGGAAGTAAAA ATGTACACTGGTACCAGCAGAGGC CAGGCCAGGCCCCTGTGTTGGTCAT CTACAGGGATAGCAACCGGCCCTC TGGGATCCCTGAGCGATTATCTGGC TCCAAAGCGGGGAACACGGCCACC CTGACCATCAGCAGAGCCCACGCC GGGGATGAGGCTGACTATTACTGTC AGGTGTGGGACAGCAGCACTGTGG TTTTCGGCGGAGGGACCGAGCTGA CCGTCCAAGGTCAGCCCAAGGCTG CACCCTCGGTCACTCTGTTCCCGCC CTCCTCTGAGGAGCTTCAAGCCAAC AAGGCCACACTGGTGTGTCTCATCA GTGACTTCTACCCGGGAGCCGTGAC AGTGGCCTGGAAGGCAGATAGCAG CCCCGTCAAGGCGGGAGTGGAAAC CACCACACCCTCCAAACAAAGCAA CAACAAGTACGCGGCCAGCAGCTA TCTGAGCCTGACGCCTGAGCAGTG GAAGTCCCACAGAAGCTACAGCTG CCAGGTCACGCATGAAGGGAGCAC CGTGGAGAAGACAGTGGCCCCTAC AGAATGTTCATAG |
| 1222 | Hu anti-huCCR8 LIBC321408-1 HuIgG1z mAb_HC | ATGGACATGAGGGTGCCCGCTCAG CTCCTGGGGCTCCTGCTGCTGTGGC TGAGAGGTGCGCGCTGTCAGGTGC AATTGGTGGAGTCTGGGGGAGGCG TGGTCCAGCCTGGGAGGTCTCTGAG ACTCTCCTGTGCAGTCTCTGGATTC ACGTTCAGTAGCAATGGCATGCACT GGGTCCGCCAGGCTCCAGGCAAGG GGCTGGAGTGGGTGGCAGTTATAT CAAATGATGGAAGTAATAAATATT ATGGAGACTCCGTGAAGGGCCGAT TCACCATCTCCAGAGACAATTCCAA GAACACGCTGTATCTGCAAATGAA CAGCCTGAGAGCTGAGGACACGGC TGTGTATTACTGTGCAAAAGTTTAC TATGGTTCGGGAATTTATTACAGAA ACAACTACTACTACGGTATGGACGT CTGGGGCCAAGGGACCACGGTCAC CGTCTCCTCAGCCTCCACCAAGGGC CCATCGGTCTTCCCCCTGGCACCCT CCTCCAAGAGCACCTCTGGGGGCA CAGCGGCCCTGGGCTGCCTGGTCA AGGACTACTTCCCCGAACCGGTGA CGGTGTCGTGGAACTCAGGCGCCCT GACCAGCGGCGTGCACACCTTCCC GGCTGTCCTACAGTCCTCAGGACTC TACTCCCTCAGCAGCGTGGTGACCG TGCCCTCCAGCAGCTTGGGCACCCA GACCTACATCTGCAACGTGAATCAC AAGCCCAGCAACACCAAGGTGGAC AAGAAAGTTGAGCCCAAATCTTGT GACAAAACTCACACATGCCCACCG TGCCCAGCACCTGAACTCCTGGGG GGACCGTCAGTCTTCCTCTTCCCCC CAAAACCCAAGGACACCCTCATGA TCTCCCGGACCCCTGAGGTCACATG CGTGGTGGTGGACGTGAGCCACGA AGACCCTGAGGTCAAGTTCAACTG |

… TABLE 20-continued

Amino acid sequences.

| SEQ ID NO: | Designation | Sequence |
|---|---|---|
| | | GTACGTGGACGGCGTGGAGGTGCA TAATGCCAAGACAAAGCCGCGGGA GGAGCAGTACAACAGCACGTACCG TGTGGTCAGCGTCCTCACCGTCCTG CACCAGGACTGGCTGAATGGCAAG GAGTACAAGTGCAAGGTGTCCAAC AAAGCCCTCCCAGCCCCCATCGAG AAAACCATCTCCAAAGCCAAAGGG CAGCCCCGAGAACCACAGGTGTAC ACCCTGCCCCCATCCCGGGAGGAG ATGACCAAGAACCAGGTCAGCCTG ACCTGCCTGGTCAAAGGCTTCTATC CCAGCGACATCGCCGTGGAGTGGG AGAGCAATGGGCAGCCGGAGAACA ACTACAAGACCACGCCTCCCGTGCT GGACTCCGACGGCTCCTTCTTCCTC TATAGCAAGCTCACCGTGGACAAG AGCAGGTGGCAGCAGGGGAACGTC TTCTCATGCTCCGTGATGCATGAGG CTCTGCACAACCACTACACGCAGA AGAGCCTCTCCCTGTCTCCGGGCAA ATAG |
| 1223 | Hu anti-huCCR8 LIBC321824-1 HuIgG1z mAb_LC | ATGGCCTGGGCTCTGCTGCTCCTCA CCCTCCTCACTCAGGGCACAGGGTC CTGGGCCTCCTATGAGCTGACTCAG CCACTCTCAGTGTCAGTGGCCCTGG GACAGACGGCCAGGATTACCTGTG GGGGAAACAACATTGGAAGTAAAA ATGTGCACTGGTACCAGCAGAAGC CAGGCCAGGCCCCTATACTGGTCAT CTATAGGAATACCAACCGGCCCTCT GGGATCCCTGAGCGATTCTCTGGCT CCAACTCGGGGAACACGGCCACCC TGACCATCAGCAGAGCCCAAGTCG GGGATGAGTCTGACTATTTCTGTCA GGTGTGGGACAGCAGCACTGTGGT ATTCGGCGGAGGGACCAAGCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1224 | Hu anti-huCCR8 LIBC321824-1 HuIgG1z mAb_HC | ATGGACATGAGGGTGCCCGCTCAG CTCCTGGGGCTCCTGCTGCTGTGGC TGAGAGGTGCGCGCTGTCAGGTGC AGGTGGTGGAGtctGGGGGAGGCGT GGTCCAGccTGGGAGGTCcCTGAGA CTCTCCTGTGGAGCCTCTGGATTCA CcttCAGtggcTATGGCATgcACTGGGT CcgcCAggcTCCAGGCAAGGGGCTGG AGTGGGTGGCAGTTATATCATATGA TGGAAGTAATAAATACTATGCAGA CTCCGTgAAGGGCCGATTCCCCATC TCAAGAgaCAATTCCAAGAACACGC TGTATCTGCAAATGAACAGcCTGAG AGGTGAGGACACGGCGGTGTATTA CTGTgcGAGAGTTTATTATGGTTCGG GGATTTATTATAAAAACCGCTacTaC TACGGTAtgGACGtctGGGGCCAAGG GACCACGGTcgcCGTCTCCTCAGCCT CCACCAAGGGCCCATCGGTCTTCCC CCTGGCACCCTCCTCCAAGAGCACC TCTGGGGGCACAGCGGCCCTGGGC TGCCTGGTCAAGGACTACTTCCCCG |

TABLE 20-continued

Amino acid sequences.

| SEQ ID NO: | Designation | Sequence |
|---|---|---|
| | | AACCGGTGACGGTGTCGTGGAACT CAGGCGCCCTGACCAGCGGCGTGC ACACCTTCCCGGCTGTCCTACAGTC CTCAGGACTCTACTCCCTCAGCAGC GTGGTGACCGTGCCCTCCAGCAGCT TGGGCACCCAGACCTACATCTGCA ACGTGAATCACAAGCCCAGCAACA CCAAGGTGGACAAGAAAGTTGAGC CCAAATCTTGTGACAAAACTCACAC ATGCCCACCGTGCCCAGCACCTGA ACTCCTGGGGGACCGTCAGTCTTC CTCTTCCCCCCAAAACCCAAGGACA CCCTCATGATCTCCCGGACCCCTGA GGTCACATGCGTGGTGGTGGACGT GAGCCACGAAGACCCTGAGGTCAA GTTCAACTGGTACGTGGACGGCGT GGAGGTGCATAATGCCAAGACAAA GCCGCGGGAGGAGCAGTACAACAG CACGTACCGTGTGGTCAGCGTCCTC ACCGTCCTGCACCAGGACTGGCTG AATGGCAAGGAGTACAAGTGCAAG GTGTCCAACAAAGCCCTCCCAGCCC CCATCGAGAAAACCATCTCCAAAG CCAAAGGGCAGCCCCGAGAACCAC AGGTGTACACCCTGCCCCCATCCCG GGAGGAGATGACCAAGAACCAGGT CAGCCTGACCTGCCTGGTCAAAGG CTTCTATCCCAGCGACATCGCCGTG GAGTGGGAGAGCAATGGGCAGCCG GAGAACAACTACAAGACCACGCCT CCCGTGCTGGACTCCGACGGCTCCT TCTTCCTCTATAGCAAGCTCACCGT GGACAAGAGCAGGTGGCAGCAGGG GAACGTCTTCTCATGCTCCGTGATG CATGAGGCTCTGCACAACCACTAC ACGCAGAAGAGCCTCTCCCTGTCTC CGGGCAAATAG |
| 1225 | Hu anti-huCCR8 LIBC321845-1 HuIgG1z mAb_LC | ATGGCCTGGGCTCTGCTGCTCCTCA CCCTCCTCACTCAGGGCACAGGGTC CTGGGCCTCCTATGAGCTGACTCAG CCACTCTCAGTGTCAGTGGCCCTGG GACAGACGGCCAGGATTACCTGTG GGGGAAACAACATTGGAAGTAAAA ATGTGCACTGGTACCAGCAGAAGC CAGGCCAGGCCCCTATACTGGTCAT CTATAGGAATACCAACCGGCCCTCT GGGATCCCTGAGCGATTCTCTGGCT CCAACTCGGGGAACACGGCCACCC TGACCATCAGCAGAGCCCAAGTCG GGGATGAGTCTGACTATTTCTGTCA GGTGTGGGACAGCAGCACTGTGGT ATTCGGCGGAGGGACCAAGCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1226 | Hu anti-huCCR8 LIBC321845-1 HuIgG1z mAb_HC | ATGGACATGAGGGTGCCCGCTCAG CTCCTGGGGCTCCTGCTGCTGTGGC TGAGAGGTGCGCGCTGTCAGGTGC AGGTGGTGGAGTCTGGGGGAGGCG TGGTCCAGCCTGGGAGGTCCCTGA GACTCTCCTGTGGAGCCTCTGGATT CACCTTCAGTGGCTATGGCATGCAC |

TABLE 20-continued

Amino acid sequences.

| SEQ ID NO: | Designation | Sequence |
|---|---|---|
| | | TGGGTCCGCCAGGCTCCAGGCAAG GGGCTGGAGTGGGTGGCAGTTATA TCATATGATGGAAGTAATAAATACT ATGCAGACTCCGTGAAGGGCCGAT TCACCATCTCAAGAGACAATTCCAA GAACACGCTGTATCTGCAAATGAA CAGCCTGAGAGGTGAGGACACGGC GGTGTATTACTGTGCGAGAGTTTAT TATGGTTCGGGGATTTATTATAAAA ACCGCTACTACTACGGTATGGACGT CTGGGGCCAAGGGACCACGGTCGC CGTCTCCTCAGCCTCCACCAAGGGC CCATCGGTCTTCCCCCTGGCACCCT CCTCCAAGAGCACCTCTGGGGGCA CAGCGGCCCTGGGCTGCCTGGTCA AGGACTACTTCCCCGAACCGGTGA CGGTGTCGTGGAACTCAGGCGCCCT GACCAGCGGCGTGCACACCTTCCC GGCTGTCCTACAGTCCTCAGGACTC TACTCCCTCAGCAGCGTGGTGACCG TGCCCTCCAGCAGCTTGGGCACCCA GACCTACATCTGCAACGTGAATCAC AAGCCCAGCAACACCAAGGTGGAC AAGAAAGTTGAGCCCAAATCTTGT GACAAAACTCACACATGCCCACCG TGCCCAGCACCTGAACTCCTGGGG GGACCGTCAGTCTTCCTCTTCCCCC CAAAACCCAAGGACACCCTCATGA TCTCCCGGACCCCTGAGGTCACATG CGTGGTGGTGGACGTGAGCCACGA AGACCCTGAGGTCAAGTTCAACTG GTACGTGGACGGCGTGGAGGTGCA TAATGCCAAGACAAAGCCGCGGGA GGAGCAGTACAACAGCACGTACCG TGTGGTCAGCGTCCTCACCGTCCTG CACCAGGACTGGCTGAATGGCAAG GAGTACAAGTGCAAGGTGTCCAAC AAAGCCCTCCCAGCCCCCATCGAG AAAACCATCTCCAAAGCCAAAGGG CAGCCCCGAGAACCACAGGTGTAC ACCCTGCCCCCATCCCGGGAGGAG ATGACCAAGAACCAGGTCAGCCTG ACCTGCCTGGTCAAAGGCTTCTATC CCAGCGACATCGCCGTGGAGTGGG AGAGCAATGGGCAGCCGGAGAACA ACTACAAGACCACGCCTCCCGTGCT GGACTCCGACGGCTCCTTCTTCCTC TATAGCAAGCTCACCGTGGACAAG AGCAGGTGGCAGCAGGGGAACGTC TTCTCATGCTCCGTGATGCATGAGG CTCTGCACAACCACTACACGCAGA AGAGCCTCTCCCTGTCTCCGGGCAA ATAG |
| 1227 | Hu anti-huCCR8 LIBC322176-1 HuIgG1z mAb_LC | ATGGCCTGGGCTCTGCTGCTCCTCA CCCTCCTCACTCAGGGCACAGGGTC CTGGGCCTCCTATGACCTGACTCAG CCACTCTCAGTGTCAGTGGCCCTGG GACAGACGGCCAGGATTACCTGTG GGGGAAACAACATTGGAGATAAAA ATGTGCACTGGTACCAGCAGAAGC CAGGCCAGGCCCCTGTGCTGGTCAT CTATAGGAATAACGTCCGGCCCTCT GGGATCCCTGAGCGATTCTCTGGCT CCAACTCGGGGAACACGGCCACCC TGACCATCAGCAGAGCCCAAGCCG GGGATGAGGCTGACTATTACTGTCA GGTGTGGGACAGCAGCACTGTGGT TTTCGGCGGAGGGACCAAGCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC |

TABLE 20-continued

Amino acid sequences.

| SEQ ID NO: | Designation | Sequence |
|---|---|---|
| | | CCCGTCAAGGCGGGAGTGGAAACC<br>ACCACACCCTCCAAACAAAGCAAC<br>AACAAGTACGCGGCCAGCAGCTAT<br>CTGAGCCTGACGCCTGAGCAGTGG<br>AAGTCCCACAGAAGCTACAGCTGC<br>CAGGTCACGCATGAAGGGAGCACC<br>GTGGAGAAGACAGTGGCCCCTACA<br>GAATGTTCATAG |
| 1228 | Hu anti-huCCR8 LIBC322176-1 HuIgG1z mAb_HC | ATGGACATGAGGGTGCCCGCTCAG<br>CTCCTGGGGCTCCTGCTGCTGTGGC<br>TGAGAGGTGCGCGCTGTCAGGTGC<br>AGCTGGTGGAATCTGGGGGAGGCG<br>TGGTCCAGCCTGGGAGGTCCCTGA<br>GACTCTCCTGTGCAGCCTCTGGGCT<br>CAACTTCAGTAACTTTGGCATGCAC<br>TGGGTCCGCCAGGCTCCAGGCAAG<br>GGGCTGGACTGGGTGGCAGTTATA<br>TCATATGATGGAGGTAATAAATACT<br>ATGCAGACTCCGTGAAGGGCCGAT<br>TCACCGTCTCCAGAGACAATTCCAA<br>GAACACGCTCTTTCTGCAAATGAAC<br>AGCCTGAGAGCTGAGGACACGGCT<br>CTGTATTACTGTGCGAAAGTTTACT<br>ATGGCTCGGGCAGTTATTATAAAA<br>AGAGGTACTACTACGGTATGGACG<br>TCTGGGGCCAGGGGACCACGGTCA<br>CCGTCTCCTCAGCCTCCACCAAGGG<br>CCCATCGGTCTTCCCCCTGGCACCC<br>TCCTCCAAGAGCACCTCTGGGGGC<br>ACAGCGGCCCTGGGCTGCCTGGTC<br>AAGGACTACTTCCCCGAACCGGTG<br>ACGGTGTCGTGGAACTCAGGCGCC<br>CTGACCAGCGGCGTGCACACCTTCC<br>CGGCTGTCCTACAGTCCTCAGGACT<br>CTACTCCCTCAGCAGCGTGGTGACC<br>GTGCCCTCCAGCAGCTTGGGCACCC<br>AGACCTACATCTGCAACGTGAATC<br>ACAAGCCCAGCAACACCAAGGTGG<br>ACAAGAAAGTTGAGCCCAAATCTT<br>GTGACAAAACTCACACATGCCCAC<br>CGTGCCCAGCACCTGAACTCCTGGG<br>GGGACCGTCAGTCTTCCTCTTCCCC<br>CCAAAACCCAAGGACACCCTCATG<br>ATCTCCCGGACCCCTGAGGTCACAT<br>GCGTGGTGGTGGACGTGAGCCACG<br>AAGACCCTGAGGTCAAGTTCAACT<br>GGTACGTGGACGGCGTGGAGGTGC<br>ATAATGCCAAGACAAAGCCGCGGG<br>AGGAGCAGTACAACAGCACGTACC<br>GTGTGGTCAGCGTCCTCACCGTCCT<br>GCACCAGGACTGGCTGAATGGCAA<br>GGAGTACAAGTGCAAGGTGTCCAA<br>CAAAGCCCTCCCAGCCCCCATCGA<br>GAAAACCATCTCCAAAGCCAAAGG<br>GCAGCCCCGAGAACCACAGGTGTA<br>CACCCTGCCCCCATCCCGGGAGGA<br>GATGACCAAGAACCAGGTCAGCCT<br>GACCTGCCTGGTCAAAGGCTTCTAT<br>CCCAGCGACATCGCCGTGGAGTGG<br>GAGAGCAATGGGCAGCCGGAGAAC<br>AACTACAAGACCACGCCTCCCGTG<br>CTGGACTCCGACGGCTCCTTCTTCC<br>TCTATAGCAAGCTCACCGTGGACA<br>AGAGCAGGTGGCAGCAGGGGAACG<br>TCTTCTCATGCTCCGTGATGCATGA<br>GGCTCTGCACAACCACTACACGCA<br>GAAGAGCCTCTCCCTGTCTCCGGGC<br>AAATAG |
| 1229 | Hu anti-huCCR8 LIBC323412-1 HuIgG1z mAb_LC | ATGGCCTGGGCTCTGCTGCTCCTCA<br>CCCTCCTCACTCAGGGCACAGGGTC<br>CTGGGCCTCCTATGAGCTGACTCAG<br>CCACTCTCAGTGTCAGTGGCCCTGG<br>GACAGACGGCCAGGATTACCTGTG |

TABLE 20-continued

Amino acid sequences.

| SEQ ID NO: | Designation | Sequence |
|---|---|---|
| | | GGGGAAACAACATTGGAAGTAAAA ATGTGCACTGGTACCAGCAGAAGC CAGGCCAGGCCCCTGTGCTGGTCAT CTATAGGGATAGCAACCGGCCCTCT GGGATCCCTGAGCGATTCTCTGGCT CCAAGTCGGGGAACACGGCCACCC TGACCATCAGCAGAGCCCAAGCCG GGGATGAGGCTGACTATTACTGTCA GGTGTGGGACAGCAGCACTGTGGT TTTCGGCGGAGGGGCCAAGCTGAC CGTCCTAGGTCAGCCCAAGGCTGC ACCCTCGGTCACTCTGTTCCCGCCC TCCTCTGAGGAGCTTCAAGCCAACA AGGCCACACTGGTGTGTCTCATCAG TGACTTCTACCCGGGAGCCGTGACA GTGGCCTGGAAGGCAGATAGCAGC CCCGTCAAGGCGGGAGTGGAAACC ACCACACCCTCCAAACAAAGCAAC AACAAGTACGCGGCCAGCAGCTAT CTGAGCCTGACGCCTGAGCAGTGG AAGTCCCACAGAAGCTACAGCTGC CAGGTCACGCATGAAGGGAGCACC GTGGAGAAGACAGTGGCCCCTACA GAATGTTCATAG |
| 1230 | Hu anti-huCCR8 LIBC323412-1 HuIgG1z mAb_HC | ATGGACATGAGGGTGCCCGCTCAG CTCCTGGGGCTCCTGCTGCTGTGGC TGAGAGGTGCGCGCTGTCAGGTGC AGCTGGTGGAGTCTGGGGGAGGCG TGGTCCAGCCTGGGAGGTCCCTGA GACTCTCCTGTGCAGCCTCTGGATT CAACTTCAGTAGCTGTGGCATGCAC TGGGTCCGCCAGGCTCCAGGCAAG GGGCTGGAGTGGGTGGCAGTTATA TCATATGATGGAACTAATAAATACT ATGCGGACTCCGTGAAGGGCCGAT TCACCATCTCCAGAGACAATTCCAA GAACACGCTGTATCTGCAAATGAA CAGCCTGAGAGCTGAGGACACGGC TGTGTATTACTGTGCGAAAGTTTAC TATGGTTCGGGTATTTATTATAAAA AGAACTACTACTACGGTATGGACG TCTGGGGCCAAGGGACCACGGTCA CCGTCTCCTCAGCCTCCACCAAGGG CCCATCGGTCTTCCCCCTGGCACCC TCCTCCAAGAGCACCTCTGGGGGC ACAGCGGCCCTGGGCTGCCTGGTC AAGGACTACTTCCCCGAACCGGTG ACGGTGTCGTGGAACTCAGGCGCC CTGACCAGCGGCGTGCACACCTTCC CGGCTGTCCTACAGTCCTCAGGACT CTACTCCCTCAGCAGCGTGGTGACC GTGCCCTCCAGCAGCTTGGGCACCC AGACCTACATCTGCAACGTGAATC ACAAGCCCAGCAACACCAAGGTGG ACAAGAAAGTTGAGCCCAAATCTT GTGACAAAACTCACACATGCCCAC CGTGCCCAGCACCTGAACTCCTGGG GGGACCGTCAGTCTTCCTCTTCCCC CCAAAACCCAAGGACACCCTCATG ATCTCCCGGACCCCTGAGGTCACAT GCGTGGTGGTGGACGTGAGCCACG AAGACCCTGAGGTCAAGTTCAACT GGTACGTGGACGGCGTGGAGGTGC ATAATGCCAAGACAAAGCCGCGGG AGGAGCAGTACAACAGCACGTACC GTGTGGTCAGCGTCCTCACCGTCCT GCACCAGGACTGGCTGAATGGCAA GGAGTACAAGTGCAAGGTGTCCAA CAAAGCCCTCCCAGCCCCCATCGA GAAAACCATCTCCAAAGCCAAAGG GCAGCCCCGAGAACCACAGGTGTA CACCCTGCCCCCATCCCGGGAGGA GATGACCAAGAACCAGGTCAGCCT GACCTGCCTGGTCAAAGGCTTCTAT |

TABLE 20-continued

Amino acid sequences.

| SEQ ID NO: | Designation | Sequence |
|---|---|---|
| | | CCCAGCGACATCGCCGTGGAGTGG<br>GAGAGCAATGGGCAGCCGGAGAAC<br>AACTACAAGACCACGCCTCCCGTG<br>CTGGACTCCGACGGCTCCTTCTTCC<br>TCTATAGCAAGCTCACCGTGGACA<br>AGAGCAGGTGGCAGCAGGGGAACG<br>TCTTCTCATGCTCCGTGATGCATGA<br>GGCTCTGCACAACCACTACACGCA<br>GAAGAGCCTCTCCCTGTCTCCGGGC<br>AAATAG |
| 1231 | huCCR8_32360_huIgG1z mAb_HC | ATGGACATGAGGGTGCCCGCTCAG<br>CTCCTGGGGCTCCTGCTGCTGTGGC<br>TGAGAGGTGCGCGCTGTGAGGTGC<br>AGCTGGTGGAGTCTGGGGGAGGCT<br>TGGTAAAGCCTGGGGGGTCCCTGA<br>GACTCTCCTGTGCAGCCTCTGGATT<br>TACTTTCAGTAACGCCCGGATGGGC<br>TGGGTCCGCCAGGCTCCAGGGAAG<br>GGGCTGGAGTGGGTTGGCCGTATT<br>AAAAGCAAAACTGAAGGTGGACA<br>AGAGACTACGCTGCACCCGTGAAA<br>GGCAGATTCACCATCTCAAGAGAT<br>GATTCAAAAAACACGCTGTATCTGC<br>AAATGAACAGCCTGAAAACCGAGG<br>ACACAGCCGTGTATTATTGTACCTC<br>GTATAGTGGGGTCTGGGGCCAAGG<br>GACAATGGTCACCGTCTCTTCAGCC<br>TCCACCAAGGGCCCATCGGTCTTCC<br>CCCTGGCACCCTCCTCCAAGAGCAC<br>CTCTGGGGGCACAGCGGCCCTGGG<br>CTGCCTGGTCAAGGACTACTTCCCC<br>GAACCGGTGACGGTGTCGTGGAAC<br>TCAGGCGCCCTGACCAGCGGCGTG<br>CACACCTTCCCGGCTGTCCTACAGT<br>CCTCAGGACTCTACTCCCTCAGCAG<br>CGTGGTGACCGTGCCCTCCAGCAGC<br>TTGGGCACCCAGACCTACATCTGCA<br>ACGTGAATCACAAGCCCAGCAACA<br>CCAAGGTGGACAAGAAAGTTGAGC<br>CCAAATCTTGTGACAAAACTCACAC<br>ATGCCCACCGTGCCCAGCACCTGA<br>ACTCCTGGGGGGACCGTCAGTCTTC<br>CTCTTCCCCCCAAAACCCAAGGACA<br>CCCTCATGATCTCCCGGACCCCTGA<br>GGTCACATGCGTGGTGGTGGACGT<br>GAGCCACGAAGACCCTGAGGTCAA<br>GTTCAACTGGTACGTGGACGGCGT<br>GGAGGTGCATAATGCCAAGACAAA<br>GCCGCGGGAGGAGCAGTACAACAG<br>CACGTACCGTGTGGTCAGCGTCCTC<br>ACCGTCCTGCACCAGGACTGGCTG<br>AATGGCAAGGAGTACAAGTGCAAG<br>GTGTCCAACAAAGCCCTCCCAGCCC<br>CCATCGAGAAAACCATCTCCAAAG<br>CCAAAGGGCAGCCCCGAGAACCAC<br>AGGTGTACACCCTGCCCCCATCCCG<br>GGAGGAGATGACCAAGAACCAGGT<br>CAGCCTGACCTGCCTGGTCAAAGG<br>CTTCTATCCCAGCGACATCGCCGTG<br>GAGTGGGAGAGCAATGGGCAGCCG<br>GAGAACAACTACAAGACCACGCCT<br>CCCGTGCTGGACTCCGACGGCTCCT<br>TCTTCCTCTATAGCAAGCTCACCGT<br>GGACAAGAGCAGGTGGCAGCAGGG<br>GAACGTCTTCTCATGCTCCGTGATG<br>CATGAGGCTCTGCACAACCACTAC<br>ACGCAGAAGAGCCTCTCCCTGTCTC<br>CGGGCAAATAG |
| 1232 | huCCR8_32360_huIgG1z mAb_LC | ATGGACATGAGGGTGCCCGCTCAG<br>CTCCTGGGGCTCCTGCTGCTGTGGC<br>TGAGAGGTGCGCGCTGTGACATCG<br>TGATGACCCAGTCTCCAGACTCCCT<br>GGCTGTGTCTCTGGGCGAGAGGGC |

TABLE 20-continued

Amino acid sequences.

| SEQ ID NO: | Designation | Sequence |
|---|---|---|
| | | CACCATCAACTGCAAGTCCAGCCA GAGTGTTTTATACAGTTCCAACAAT AAGAACTACTTAGCTTGGTACCATC AGAAACCAGGACAGTCTCCTAAGC TGCTCATTTCCTGGGCATCTACCCG GGAATCCGGGTCCCTGACCGATTC AGTGGCAGCGGGTCTGGGACAGAT TTCACTCTCACCATCAACAGCCTGC AGGCTGAAGATGTGGCAGTTTATTA CTGTCAACAATATTATAGTATTCCG ATCACTTTCGGCGGAGGGACCAAG GTGGAGATCAAACGAACGGTGGCT GCACCATCTGTCTTCATCTTCCCGC CATCTGATGAGCAGTTGAAATCTGG AACTGCCTCTGTTGTGTGCCTGCTG AATAACTTCTATCCCAGAGAGGCC AAAGTACAGTGGAAGGTGGATAAC GCCCTCCAATCGGGTAACTCCCAGG AGAGTGTCACAGAGCAGGACAGCA AGGACAGCACCTACAGCCTCAGCA GCACCCTGACGCTGAGCAAAGCAG ACTACGAGAAACACAAAGTCTACG CCTGCGAAGTCACCCATCAGGGCCT GAGCTCGCCCGTCACAAAGAGCTT CAACAGGGGAGAGTGTTAG |
| 1233 | HCDR1 Consensus | $X_1X_2GX_4H$<br>$X_1$ = N, S, D, G, T, or R, $X_2$ = C, N, Y, S, or F, $X_4$ = M or F |
| 1234 | LCDR2 Consensus | $RX_2X_3X_4RPS$<br>$X_2$ = A, N, D, S, or Q, $X_3$ = S, T, N, I, F, or A, and $X_4$ = N or V |
| 1235 | LCDR1 consensus | KSSQSVLYSSNNX$_1$NYLA; $X_1$ is K or R |
| 1236 | LCVR consensus | DIVMTQSPDSLAVSLGERATINCKSS QSVLYSSNNX$_1$NYLA WYX$_2$QKPGQX$_3$PKLLISWASTRESGV PDRFSGSGSGTDFTLTINSLQAEDVA VYYCQQYYSIPITFGGGTKVEIKR, wherein $X_1$ is K or R, $X_2$ is H or Q, and/or $X_3$ is S or P |
| 1237 | huCCR8_32360_huIgG1z mAb(LC:K38R)_HC_no Cterm K | EVQLVESGGGLVKPGGSLRLSCAAS GFTFSNARMGWVRQAPGKGLEWVG RIKSKTEGGTRDYAAPVKGRFTISRD DSKNTLYLQMNSLKTEDTAVYYCTS YSGVWGQGTMVTVSSASTKGPSVFP LAPSSKSTSGGTAALGCLVKDYFPEP VTVSWNSGALTSGVHTFPAVLQSSG LYSLSSVVTVPSSSLGTQTYICNVNH KPSNTKVDKKVEPKSCDKTHTCPPCP APELLGGPSVFLFPPKPKDTLMISRTP EVTCVVVDVSHEDPEVKFNWYVDG VEVHNAKTKPREEQYNSTYRVVSVL TVLHQDWLNGKEYKCKVSNKALPA PIEKTISKAKGQPREPQVYTLPPSREE MTKNQVSLTCLVKGFYPSDIAVEWE SNGQPENNYKTTPPVLDSDGSFFLYS KLTVDKSRWQQGNVFSCSVMHEAL HNHYTQKSLSLSPG |
| 1238 | anti-huCCR8_44379(VH:D72S, VL:N67A_S68A_M99G_W109F_S111A)_huIgG1z (mAb)_HC_no Cterm K | QVQLVESGGGVVQPGRSLRLSCAAS GFTFSNYGFHWVRQTPGKGLEWVA VISYDGSNRYYASSVKGRFTISRDNS KNTLYLQMNSLRGEDTALYYCARV YYGSGTYYKNRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR |

TABLE 20-continued

Amino acid sequences.

| SEQ ID NO: | Designation | Sequence |
|---|---|---|
| | | EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1239 | anti-huCCR8_44379(VH:D61A_D72A, VL:N67Q_M99E_W109F_S111A)_huIgG1z (mAb)_HC_no Cterm K | QVQLVESGGGVVQPGRSLRLSCAAS GFTFSNYGFHWVRQTPGKGLEWVA VISYAGSNRYYAASVKGRFTISRDNS KNTLYLQMNSLRGEDTALYYCARV YYGSGTYYKNRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1240 | anti-huCCR8_44379(VH:D61S, VL:N67Q_M99G_W109F_S111A)_huIgG1z (mAb)_HC_no Cterm K | QVQLVESGGGVVQPGRSLRLSCAAS GFTFSNYGFHWVRQTPGKGLEWVA VISYSGSNRYYADSVKGRFTISRDNS KNTLYLQMNSLRGEDTALYYCARV YYGSGTYYKNRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1241 | Hu anti-huCCR8 LIBC315615-1 HuIgG1z mAb_HC_no Cterm K | QVQLVESGGGVAQPGRSLRLSCAAS GFNFSNCGMHWVRQAPGKGLEWVA VISYDGGNKYHADSVKGRFTISRDDS KNTLYLQMDSLRTEDTAVYYCAKV YYGSGIYYKNRYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1242 | Hu anti-huCCR8 LIBC317152-1 HuIgG1z mAb_HC_no Cterm K | QVQLVESGGGVAQPGRSLRLSCAAS GFNFSNCGMHWVRQAPGKGLEWVA VISYDGGNKYYADSVKGRFTISRDDS KNTLYLQMDSLRTEDTAVYYCAKV YYGSGIYYKNRYYYGMDVWGQGTT VTVSSASTKGPSVFPLAPSSKSTSGGT AALGCLVKDYFPEPVTVSWNSGALT |

TABLE 20-continued

Amino acid sequences.

| SEQ ID NO: | Designation | Sequence |
|---|---|---|
| | | SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1243 | Hu anti-huCCR8 LIBC317471-1 HuIgG1z mAb_HC_no Cterm K | QVQLVESGGGVVQPGRSLRLSCVVS GFNFSNNGMHWVRQAPGKGLEWVA VISNDGSNKYYADSVRGRFTISRDNS KNTLYLQMNSLRAEDTAVYSCAKV YYGSGIYYKNNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1244 | Hu anti-huCCR8 LIBC317977-1 HuIgG1z mAb_HC_no Cterm K | QVQLVESGGGVVQPGRSLRLSCAAS GFNFNTYGMHWVRQAPGKGLEWVA VISYDGSNKYYADSVKGRFTISRDNS KSTLYLQMNSLRAEDTAVYYCARVY YGSGSYYKKNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1245 | Hu anti-huCCR8 LIBC318774-1 HuIgG1z mAb_HC_no Cterm K | QVQVVESGGGVVQPGRSLRLSCAAS GFTLSSYGFHWVRQTPGKGLEWVAV ISYDGSNKYYADSVKGRFTISRDNSK NTLYLQMNSLRGEDTAVYYCARVY YGSGTYYKNRYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |

TABLE 20-continued

Amino acid sequences.

| SEQ ID NO: | Designation | Sequence |
|---|---|---|
| 1246 | Hu anti-huCCR8 LIBC319840-1 HuIgG1z mAb_HC_no Cterm K | QVQLVESGGGVVQPGRSLRLSCVVS GFNFINNGMHWVRQAPGKGLDWVA VISNDGSNKYYPDSVKGRFTISRDNS KNTLYLQMNSLRAEDSAVYYCAKV YYGSGNYYKNNYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1247 | Hu anti-huCCR8 LIBC320212-1 HuIgG1z mAb_HC_no Cterm K | QMQVVESGGGVVQPGRSLRLSCAAS GFTFSSSGMHWVRQAPGKGLEWVA VISHDGSNKYYADSVKGRFTISRDNS KNTLYLQMNSLGGEDTAVYYCAKV YYGSGIYYKNRYYYGMDVWGQGTT VIVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1248 | Hu anti-huCCR8 LIBC320384-1 HuIgG1z mAb_HC_no Cterm K | QVQLVESGGGVAQPGRSLRLSCAAS GFNFSDCGMHWVRQAPGKGLEWVA VISYDGGNKYYADSVKGRFTISRDDS KNTLYLQTDSLRTEDTAVYYCAKVY YGSGIYYKNRYYYGMDVWGQGTTV TVSSASTKGPSVFPLAPSSKSTSGGTA ALGCLVKDYFPEPVTVSWNSGALTS GVHTFPAVLQSSGLYSLSSVVTVPSS SLGTQTYICNVNHKPSNTKVDKKVE PKSCDKTHTCPPCPAPELLGGPSVFLF PPKPKDTLMISRTPEVTCVVVDVSHE DPEVKFNWYVDGVEVHNAKTKPRE EQYNSTYRVVSVLTVLHQDWLNGK EYKCKVSNKALPAPIEKTISKAKGQP REPQVYTLPPSREEMTKNQVSLTCLV KGFYPSDIAVEWESNGQPENNYKTTP PVLDSDGSFFLYSKLTVDKSRWQQG NVFSCSVMHEALHNHYTQKSLSLSP G |
| 1249 | Hu anti-huCCR8 LIBC320689-1 HuIgG1z mAb_HC_no Cterm K | QVQVVESGGGVVQPGRSLRLSCAAS GFTFSSYGMHWVRQAPGKGLEWVA VISFDGNNKYYADSVKGRFTISRDNS KNTLYLQMNSLRGEDTAVYYCARV YYGSGSYYKNRYYYGMDVWGQGT TVTVSTASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ |

TABLE 20-continued

Amino acid sequences.

| SEQ ID NO: | Designation | Sequence |
|---|---|---|
|  |  | PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1250 | Hu anti-huCCR8 LIBC321408-1 HuIgG1z mAb_HC_no Cterm K | QVQLVESGGGVVQPGRSLRLSCAVS GFTFSSNGMHWVRQAPGKGLEWVA VISNDGSNKYYGDSVKGRFTISRDNS KNTLYLQMNSLRAEDTAVYYCAKV YYGSGIYYRNNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1251 | Hu anti-huCCR8 LIBC321824-1 HuIgG1z mAb_HC_no Cterm K | QVQVVESGGGVVQPGRSLRLSCGAS GFTFSGYGMHWVRQAPGKGLEWVA VISYDGSNKYYADSVKGRFPISRDNS KNTLYLQMNSLRGEDTAVYYCARV YYGSGIYYKNRYYYGMDVWGQGTT VAVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1252 | Hu anti-huCCR8 LIBC321845-1 HuIgG1z mAb_HC_no Cterm K | QVQVVESGGGVVQPGRSLRLSCGAS GFTFSGYGMHWVRQAPGKGLEWVA VISYDGSNKYYADSVKGRFTISRDNS KNTLYLQMNSLRGEDTAVYYCARV YYGSGIYYKNRYYYGMDVWGQGTT VAVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1253 | Hu anti-huCCR8 LIBC322176-1 HuIgG1z mAb_HC_no Cterm K | QVQLVESGGGVVQPGRSLRLSCAAS GLNFSNFGMHWVRQAPGKGLDWVA VISYDGGNKYYADSVKGRFTVSRDN SKNTLFLQMNSLRAEDTALYYCAKV YYGSGSYYKKRYYYGMDVWGQGT TVTVSSASTKGPSVFPLAPSSKSTSGG TAALGCLVKDYFPEPVTVSWNSGAL TSGVHTFPAVLQSSGLYSLSSVVTVP SSSLGTQTYICNVNHKPSNTKVDKKV |

TABLE 20-continued

Amino acid sequences.

| SEQ ID NO: | Designation | Sequence |
|---|---|---|
| | | EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |
| 1254 | Hu anti-huCCR8 LIBC323412-1 HuIgG1z mAb_HC_no Cterm K | QVQLVESGGGVVQPGRSLRLSCAAS GFNFSSCGMHWVRQAPGKGLEWVA VISYDGTNKYYADSVKGRFTISRDNS KNTLYLQMNSLRAEDTAVYYCAKV YYGSGIYYKKNYYYGMDVWGQGTT VTVSSASTKGPSVFPLAPSSKSTSGGT AALGCLVKDYFPEPVTVSWNSGALT SGVHTFPAVLQSSGLYSLSSVVTVPS SSLGTQTYICNVNHKPSNTKVDKKV EPKSCDKTHTCPPCPAPELLGGPSVFL FPPKPKDTLMISRTPEVTCVVVDVSH EDPEVKFNWYVDGVEVHNAKTKPR EEQYNSTYRVVSVLTVLHQDWLNG KEYKCKVSNKALPAPIEKTISKAKGQ PREPQVYTLPPSREEMTKNQVSLTCL VKGFYPSDIAVEWESNGQPENNYKT TPPVLDSDGSFFLYSKLTVDKSRWQQ GNVFSCSVMHEALHNHYTQKSLSLS PG |

SEQUENCE LISTING (1254 sequences)

SEQ ID NO: 1 - protein, 5 aa, Artificial Sequence
  Synthetic Peptide
NARMG

SEQ ID NO: 2 - protein, 19 aa, Artificial Sequence
  Synthetic Peptide
RIKSKTEGGTRDYAAPVKG

SEQ ID NO: 3 - protein, 4 aa, Artificial Sequence
  Synthetic Peptide
YSGV

SEQ ID NO: 4 - protein, 17 aa, Artificial Sequence
  Synthetic Peptide
KSSQSVLYSSNNKNYLA

SEQ ID NO: 5 - protein, 7 aa, Artificial Sequence
  Synthetic Peptide
WASTRES

SEQ ID NO: 6 - protein, 9 aa, Artificial Sequence
  Synthetic Peptide
QQYYSIPIT

SEQ ID NO: 7 - protein, 5 aa, Artificial Sequence
  Synthetic Peptide
NYGMH

SEQ ID NO: 8 - protein, 17 aa, Artificial Sequence
  Synthetic Peptide
VISYDGSNKFYADSVKG

SEQ ID NO: 9 - protein, 9 aa, Artificial Sequence
  Synthetic Peptide
AGGIGRFDY

SEQ ID NO: 10 - protein, 9 aa, Artificial Sequence
  Synthetic Peptide
AGGIGRFDY

SEQ ID NO: 11 - protein, 7 aa, Artificial Sequence
  Synthetic Peptide
EVSNRFS

SEQ ID NO: 12 - protein, 7 aa, Artificial Sequence
  Synthetic Peptide
EVSNRFS

SEQ ID NO: 13 - protein, 115 aa, Artificial Sequence
  Synthetic Peptide
EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSS

SEQ ID NO: 14 - protein, 114 aa, Artificial Sequence
  Synthetic Peptide
DIVMTQSPDSLAVSLGERATINCKSSQSVLYSSNNKNYLAWYHQKPGQSPKLLISWASTRESGVPDRFSGSGSGTDFTLTINSLQAEDVAVYYCQQYYSIPITFGGGTKVEIKR

SEQ ID NO: 15 - protein, 441 aa, Artificial Sequence
  Synthetic Peptide
EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 16 - protein, 220 aa, Artificial Sequence
  Synthetic Peptide
DIVMTQSPDSLAVSLGERATINCKSSQSVLYSSNNKNYLAWYHQKPGQSPKLLISWASTRESGVPDRFSGSGSGTDFTLTINSLQAEDVAVYYCQQYYSIPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 118 aa, Artificial Sequence
  Synthetic Peptide
QVQLVESGGGVVQPGRSLRLSCAASGFTFSNYGMHWVRQAPGKGLEWVAVISYDGSNKFYADSVKGRFTISRDNSKKTLYLQMSSLRVEDTAVYYCARAGGIGRFDYWGQGTLVTVSS

SEQ ID NO: 18 - protein, 112 aa, Artificial Sequence
  Synthetic Peptide
DFVMTQTPLSLSVTPGQPASISCKYSQSLLHSDGKTYLFWYLQKPGQPPHLLIYEVSNRFSGVPDRFSGSGSGTDFTLKISRVEAEDVGLYYCMQTLKLPLTFGGGTKVEIN

SEQ ID NO: 19 - protein, 444 aa, Artificial Sequence
  Synthetic Peptide
QVQLVESGGGVVQPGRSLRLSCAASGFTFSNYGMHWVRQAPGKGLEWVAVISYDGSNKFYADSVKGRFTISRDNSKKTLYLQMSSLRVEDTAVYYCARAGGIGRFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 20 - protein, 219 aa, Artificial Sequence
  Synthetic Peptide
DFVMTQTPLSLSVTPGQPASISCKYSQSLLHSDGKTYLFWYLQKPGQPPHLLIYEVSNRFSGVPDRFSGSGSGTDFTLKISRVEAEDVGLYYCMQTLKLPLTFGGGTKVEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 355 aa, Artificial Sequence
  Synthetic Peptide
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 22 - protein, 355 aa, Artificial Sequence
  Synthetic Peptide
MDYTLDPSMTTMTDYYYPDSLSSPCDGELIQRNDKLLLAVFYCLLFVFSLLGNSLVILVLVVCKKLRNITDIYLLNLALSDLLFVFSFPFQTYYQLDQWVFGTVMCKVVSGFYYIGFYSSMFFITLMSVDRYLAVVHAVYAIKVRTIRMGTTLSLVVWLTAIMATIPLLVFYQVASEDGVLQCYSFYNQQTLKWKIFTNFEMNILGLLIPFTIFMFCYIKILHQLKRCQNHNKTKAIRLVLIVVIASLLFWVPFNVVLFLTSLHSMHILDGCSISQQLNYATHVTEIISFTHCCVNPVIYAFVGEKFKKHLSEIFQKSCSHIFIYLGRQMPRESCEKSSSCQQHSFRSSSIDYIL

SEQ ID NO: 23 - protein, 355 aa, Artificial Sequence [sequence omitted]

SEQ ID NO: 24 - protein, 353 aa, Artificial Sequence
  Synthetic Peptide
MDYTMEPNVTMTDYYPDFFTAPCDAEFLLRGSMLYLAILYCVLFVLGLLGNSLVILVLVGCKKLRSITDIYLLNLAASDLLFVLSIPFQTHNLLDQWVFGTAMCKVVSGLYYIGFFSSMFFITLMSVDRYLAIVHAVYAIKVRTASVGTALSLTVWLAAVTATIPLMVFYQVASEDGMLQCFQFYEEQSLRWKLFTHFEINALGLLLPFAILLFCYVRILQQLRGCLNHNRTRAIKLVLTVVIVSLLFWVPFNVALFLTSLHDLHILDGCATRQRLALAIHVTEVISFTHCCVNPVIYAFIGEKFKKHLMDVFQKSCSHIFLYLGRQMPVGALERQLSSNQRSSHSSTLDDIL

SEQ ID NO: 25 - protein, 353 aa, Artificial Sequence
  Synthetic Peptide
MDYTLEPNVTMTDYYPDFFTTPCDTELLLRGGTLYLAVLYCILFVLGLLGNSLVILVLVACKKLRSITDVYLLNLAASDLLFVLSIPFQTHNLLDQWVFGTVMCKVVSGLYYIGFFSSMLFITLMSVDRYLAVVHPVHAIKVRTARVGTALSLAVWLAAIAATVPLMVFYQVSSEDGMLQCFQLYDEQSLRWKLFTHFEVNALGLLLPFAILLFCYVRILQQLRGCLNHNRTRAIKLVLTIVVVSLLFWVPFNVVLFLTSLHDMHILEGCATRQRLALATHVTEVISFMHCCVNPVIYAFIGEKFKKHLVDVFQKSCSHIFLYVGRQMPVGALERQLSSNQRSSHSSTLDYIL

SEQ ID NO: 26 - protein, 360 aa, Artificial Sequence
  Synthetic Peptide
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 27 - DNA, 1326 bp, Artificial Sequence
  Synthetic Peptide
gaggtgcagctggtggagtctgggggaggcttggtaaagcctggggggtccctgagactctcctgtgcagcctctggatttactttcagtaacgcccggatgggctgggtccgccaggctccagggaaggggctggagtgggttggccgtattaaaagcaaaactgaaggtgggacaagagactacgctgcacccgtgaaaggcagattcaccatctcaagagatgattcaaaaaacacgctgtatctgcaaatgaacagcctgaaaaccgaggacacagccgtgtattattgtacctcgtatagtggggtctggggccaagggacaatggtcaccgtctcttcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatag

SEQ ID NO: 28 - DNA, 342 bp, Artificial Sequence
  Synthetic Peptide
gacatcgtgatgacccagtctccagactccctggctgtgtctctgggcgagagggccaccatcaactgcaagtccagccagagtgttttatacagttccaacaataagaactacttagcttggtaccatcagaaaccaggacagtctcctaagctgctcatttcctgggcatctacccgggaatccggggtccctgaccgattcagtggcagcgggtctgggacagatttcactctcaccatcaacagcctgcaggctgaagatgtggcagtttattactgtcaacaatattatagtattccgatcactttcggcggagggaccaaggtggagatcaaacga

SEQ ID NO: 29 - DNA, 1335 bp, Artificial Sequence
  Synthetic Peptide
caggtgcagttggtggagtctgggggaggcgtggtccagcctgggaggtccctgagactctcctgtgcagcctctggattcaccttcagtaactatggcatgcactgggtccgccaggctccaggcaaggggctggagtgggtggcagtcatatcatatgatggaagtaataaattctatgcagactccgtgaagggccgattcaccatctccagagacaattccaagaagactctgtatcttcaaatgagcagcctgagagttgaggacacggctgtatattattgtgcgagagccgggggtatagggcgttttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatag

SEQ ID NO: 30 - DNA, 339 bp, Artificial Sequence
  Synthetic Peptide
gattttgtaatgacccagactccactctctctgtccgtcacccctggacagccggcctccatctcctgcaagtatagtcagagcctcctgcacagtgatggaaagacctatttgttttggtacctgcagaagccaggccagcctccacacctcctgatctatgaagtttccaaccggttctctggagtgccagataggttcagtggcagcgggtcagggacagatttcacactgaagatcagccgggtggaggctgaggatgttgggctttattactgcatgcaaactttaaagcttccgctcactttcggcggagggaccaaggtggagatcaaccga

SEQ ID NO: 31 - protein, 35 aa, Artificial Sequence
  Synthetic Peptide
MDYTLDLSVTTVTDYYYPDIFSSPCDAELIQTNGK

SEQ ID NO: 32 - protein, 11 aa, Artificial Sequence
  Synthetic Peptide
RASQGISNWLA

SEQ ID NO: 33 - protein, 7 aa, Artificial Sequence
  Synthetic Peptide
AASSLQS

SEQ ID NO: 34 - protein, 9 aa, Artificial Sequence
  Synthetic Peptide
QQAESFPHT

SEQ ID NO: 35 - protein, 5 aa, Artificial Sequence
  Synthetic Peptide
SYDMS

SEQ ID NO: 36 - protein, 17 aa, Artificial Sequence
  Synthetic Peptide
LISGGGSQTYYAESVKG

SEQ ID NO: 37 - protein, 11 aa, Artificial Sequence
  Synthetic Peptide
PSGHYFYAMDV

SEQ ID NO: 38 - protein, 107 aa, Artificial Sequence
  Synthetic Peptide
DIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIK

SEQ ID NO: 39 - protein, 120 aa, Artificial Sequence
  Synthetic Peptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSS

SEQ ID NO: 40 - protein, 214 aa, Artificial Sequence
  Synthetic Peptide
DIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 450 aa, Artificial Sequence
  Synthetic Peptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 11 aa, Artificial Sequence
  Synthetic Peptide
SGDKLGDKYAS

SEQ ID NO: 43 - protein, 7 aa, Artificial Sequence
  Synthetic Peptide
QDRKRPS

SEQ ID NO: 44 - protein, 9 aa, Artificial Sequence
  Synthetic Peptide
QAFESSTEV

SEQ ID NO: 45 - protein, 5 aa, Artificial Sequence
  Synthetic Peptide
NYGMH

SEQ ID NO: 46 - protein, 17 aa, Artificial Sequence
  Synthetic Peptide
LIWYDASKKYYAESVKG

SEQ ID NO: 47 - protein, 16 aa, Artificial Sequence
  Synthetic Peptide
DPSSLTGSTGYYGMDV

SEQ ID NO: 48 - protein, 106 aa, Artificial Sequence
  Synthetic Peptide
SYELTQPPSVSVSPGQTASITCSGDKLGDKYASWYQQKPGQSPVLVIYQDRKRPSGIPERFSGSNSGNTATLTISGTQAMDEADYYCQAFESSTEVFGGGTKLTVL

SEQ ID NO: 49 - protein, 125 aa, Artificial Sequence
  Synthetic Peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSS

SEQ ID NO: 50 - protein, 212 aa, Artificial Sequence
  Synthetic Peptide
SYELTQPPSVSVSPGQTASITCSGDKLGDKYASWYQQKPGQSPVLVIYQDRKRPSGIPERFSGSNSGNTATLTISGTQAMDEADYYCQAFESSTEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 51 - protein, 455 aa, Artificial Sequence
  Synthetic Peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 11 aa, Artificial Sequence
  Synthetic Peptide
SGDALPKKYAY

SEQ ID NO: 53 - protein, 7 aa, Artificial Sequence
  Synthetic Peptide
EDAKRPS

SEQ ID NO: 54 - protein, 11 aa, Artificial Sequence
  Synthetic Peptide
YSTDASGNHRV

SEQ ID NO: 55 - protein, 5 aa, Artificial Sequence
  Synthetic Peptide
DYSMS

SEQ ID NO: 56 - protein, 17 aa, Artificial Sequence
  Synthetic Peptide
GINWNGGRTRYADAVKG

SEQ ID NO: 57 - protein, 12 aa, Artificial Sequence
  Synthetic Peptide
EFNNFESNWFDP

SEQ ID NO: 58 - protein, 108 aa, Artificial Sequence
  Synthetic Peptide
SYELTQPPSVSVSPGQTARITCSGDALPKKYAYWYQQKPGQAPVLVISEDAKRPSGIPERFSGSSSGTMATLTISGAQVEDEADYYCYSTDASGNHRVFGGGTKLTVL

SEQ ID NO: 59 - protein, 121 aa, Artificial Sequence
  Synthetic Peptide
EVQLVESGGSVVRPGGSLRLSCAASGFTVDDYSMSWVRQVPGKGLEWVSGINWNGGRTRYADAVKGRFTISRDSAKNSLYLQMNSLRAEDTALYYCAREFNNFESNWFDPWGQGTLVTVSS

SEQ ID NO: 60 - protein, 214 aa, Artificial Sequence
  Synthetic Peptide
SYELTQPPSVSVSPGQTARITCSGDALPKKYAYWYQQKPGQAPVLVISEDAKRPSGIPERFSGSSSGTMATLTISGAQVEDEADYYCYSTDASGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61 - protein, 451 aa, Artificial Sequence
  Synthetic Peptide
EVQLVESGGSVVRPGGSLRLSCAASGFTVDDYSMSWVRQVPGKGLEWVSGINWNGGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 11 aa, Artificial Sequence
  Synthetic Peptide
SGDALPKKYAY

SEQ ID NO: 63 - protein, 7 aa, Artificial Sequence
  Synthetic Peptide
EDAKRPS

SEQ ID NO: 64 - protein, 11 aa, Artificial Sequence
  Synthetic Peptide
YSTDASGNHRV

SEQ ID NO: 65 - protein, 5 aa, Artificial Sequence
  Synthetic Peptide
DYSMS

SEQ ID NO: 66 - protein, 17 aa, Artificial Sequence
  Synthetic Peptide
GINWNAGRTRYADAVKG

SEQ ID NO: 67 - protein, 12 aa, Artificial Sequence
  Synthetic Peptide
EFNNFESNWFDP

SEQ ID NO: 68 - protein, 108 aa, Artificial Sequence; identical to SEQ ID NO: 58
  Synthetic Peptide

SEQ ID NO: 69 - protein, 121 aa, Artificial Sequence
  Synthetic Peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSS

SEQ ID NO: 70 - protein, 214 aa, Artificial Sequence; identical to SEQ ID NO: 60
  Synthetic Peptide

SEQ ID NO: 71 - protein, 451 aa, Artificial Sequence
  Synthetic Peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 11 aa, Artificial Sequence
  Synthetic Peptide
RASQGISNWLA

SEQ ID NO: 73 - protein, 7 aa, Artificial Sequence
  Synthetic Peptide
AASSLQS

SEQ ID NO: 74 - protein, 9 aa, Artificial Sequence
  Synthetic Peptide
QQAESFPHT

SEQ ID NO: 75 - protein, 5 aa, Artificial Sequence
  Synthetic Peptide
SYDMS

SEQ ID NO: 76 - protein, 17 aa, Artificial Sequence
  Synthetic Peptide
LISGGGSNTYYAESVKG

SEQ ID NO: 77 - protein, 11 aa, Artificial Sequence
  Synthetic Peptide
PSGHYFYAMDV

SEQ ID NO: 78 - protein, 107 aa, Artificial Sequence; identical to SEQ ID NO: 38
  Synthetic Peptide

SEQ ID NO: 79 - protein, 120 aa, Artificial Sequence
  Synthetic Peptide
EVQLLESGGGLVQPGGSLRLSCAASGFTFSSYDMSWVRQAPGKGLEWVSLISGGGSNTYYAESVKGRFTISRDNSKNTLYLQMNSLRAEDTAVYFCASPSGHYFYAMDVWGQGTTVTVSS

SEQ ID NO: 80 - protein, 214 aa, Artificial Sequence; identical to SEQ ID NO: 40
  Synthetic Peptide

SEQ ID NO: 81 - protein, 450 aa, Artificial Sequence
  Synthetic Peptide
EVQLLESGGGLVQPGGSLRLSCAASGFTFSSYDMSWVRQAPGKGLEWVSLISGGGSNTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 12 aa, Artificial Sequence
  Synthetic Peptide
MDYTLDLSVTTV

SEQ ID NO: 83 - protein, 12 aa, Artificial Sequence
  Synthetic Peptide
TDYYYPDIFSSP

SEQ ID NO: 84 - protein, 11 aa, Artificial Sequence
  Synthetic Peptide
CDAELIQTNGK

SEQ ID NO: 85 - protein, 12 aa, Artificial Sequence
  Synthetic Peptide
LSVTTVTDYYYP

SEQ ID NO: 86 - protein, 12 aa, Artificial Sequence
  Synthetic Peptide
DIFSSPCDAELI

SEQ ID NO: 87 - protein, 14 aa, Artificial Sequence
  Synthetic Peptide
GSSTGAVTSGNYPN

SEQ ID NO: 88 - protein, 7 aa, Artificial Sequence
  Synthetic Peptide
GTKFLAP

SEQ ID NO: 89 - protein, 9 aa, Artificial Sequence
  Synthetic Peptide
VLWYSNRWV

SEQ ID NO: 90 - protein, 5 aa, Artificial Sequence
  Synthetic Peptide
KYAMN

SEQ ID NO: 91 - protein, 19 aa, Artificial Sequence
  Synthetic Peptide
RIRSKYNNYATYYADSVKD

SEQ ID NO: 92 - protein, 14 aa, Artificial Sequence
  Synthetic Peptide
HGNFGNSYISYWAY

SEQ ID NO: 93 - protein, 125 aa, Artificial Sequence
  Synthetic Peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 94 - protein, 109 aa, Artificial Sequence
  Synthetic Peptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 95 - protein, 249 aa, Artificial Sequence
  Synthetic Peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 96 - protein, 14 aa, Artificial Sequence
  Synthetic Peptide
GSSTGAVTSGNYPN

SEQ ID NO: 97 - protein, 7 aa, Artificial Sequence
  Synthetic Peptide
GTKFLAP

SEQ ID NO: 98 - protein, 9 aa, Artificial Sequence
  Synthetic Peptide
VLWYSNRWV

SEQ ID NO: 99 - protein, 5 aa, Artificial Sequence
  Synthetic Peptide
KYAIN

SEQ ID NO: 100 - protein, 19 aa, Artificial Sequence
  Synthetic Peptide
RIRSKYNNYATYYADAVKD

SEQ ID NO: 101 - protein, 14 aa, Artificial Sequence
  Synthetic Peptide
AGNFGSSYISYWAY

SEQ ID NO: 102 - protein, 125 aa, Artificial Sequence
  Synthetic Peptide
EVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSS

SEQ ID NO: 103 - protein, 109 aa, Artificial Sequence
  Synthetic Peptide
QTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVL

SEQ ID NO: 104 - protein, 17 aa, Artificial Sequence
  Synthetic Peptide
KSSQSVLDSSTNKNSLA

SEQ ID NO: 105 - protein, 7 aa, Artificial Sequence
  Synthetic Peptide
WASTRES

SEQ ID NO: 106 - protein, 9 aa, Artificial Sequence
  Synthetic Peptide
QQSAHFPIT

SEQ ID NO: 107 - protein, 5 aa, Artificial Sequence
  Synthetic Peptide
NYGMN

SEQ ID NO: 108 - protein, 17 aa, Artificial Sequence
  Synthetic Peptide
WINTYTGEPTYADKFQG

SEQ ID NO: 109 - protein, 13 aa, Artificial Sequence
  Synthetic Peptide
WSWSDGYYVYFDY

SEQ ID NO: 110 - protein, 122 aa, Artificial Sequence
  Synthetic Peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSS

SEQ ID NO: 111 - protein, 122 aa, Artificial Sequence
  Synthetic Peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSS

SEQ ID NO: 112 - protein, 113 aa, Artificial Sequence
  Synthetic Peptide
DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIK

SEQ ID NO: 113 - protein, 113 aa, Artificial Sequence
  Synthetic Peptide
DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK

SEQ ID NO: 114 - protein, 250 aa, Artificial Sequence
  Synthetic Peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIK

SEQ ID NO: 115 - protein, 250 aa, Artificial Sequence
  Synthetic Peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK

SEQ ID NO: 116 - protein, 505 aa, Artificial Sequence
  Synthetic Peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 117 - protein, 993 aa, Artificial Sequence
  Synthetic Peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 511 aa, Artificial Sequence
  Synthetic Peptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 119 - protein, 16 aa, Artificial Sequence
  Synthetic Peptide
RSSQSLVHSDGNTYLS

SEQ ID NO: 120 - protein, 7 aa, Artificial Sequence
  Synthetic Peptide
RISRRFS

SEQ ID NO: 121 - protein, 9 aa, Artificial Sequence
  Synthetic Peptide
MQSTHVPRT

SEQ ID NO: 122 - protein, 5 aa, Artificial Sequence
  Synthetic Peptide
NYGMH

SEQ ID NO: 123 - protein, 17 aa, Artificial Sequence
  Synthetic Peptide
VIWYDGSDKYYADSVRG

SEQ ID NO: 124 - protein, 15 aa, Artificial Sequence
  Synthetic Peptide
DGYDILTGNPRDFDY

SEQ ID NO: 125 - protein, 124 aa, Artificial Sequence
  Synthetic Peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSS

SEQ ID NO: 126 - protein, 112 aa, Artificial Sequence
  Synthetic Peptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIK

SEQ ID NO: 127 - protein, 251 aa, Artificial Sequence
  Synthetic Peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIK

SEQ ID NO: 128 - protein, 506 aa, Artificial Sequence
  Synthetic Peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 129 - protein, 994 aa, Artificial Sequence
  Synthetic Peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 5 aa, Artificial Sequence
  Synthetic Peptide
DYYMT

SEQ ID NO: 131 - protein, 17 aa, Artificial Sequence
  Synthetic Peptide
YISSSGSTIYYADSVKG

SEQ ID NO: 132 - protein, 8 aa, Artificial Sequence
  Synthetic Peptide
DRNSHFDY

SEQ ID NO: 133 - protein, 11 aa, Artificial Sequence
  Synthetic Peptide
RASQGINTWLA

SEQ ID NO: 134 - protein, 7 aa, Artificial Sequence
  Synthetic Peptide
GASGLQS

SEQ ID NO: 135 - protein, 9 aa, Artificial Sequence
  Synthetic Peptide
QQAKSFPRT

SEQ ID NO: 136 - protein, 117 aa, Artificial Sequence
  Synthetic Peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSS

SEQ ID NO: 137 - protein, 107 aa, Artificial Sequence
  Synthetic Peptide
DIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 138 - protein, 239 aa, Artificial Sequence
  Synthetic Peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 139 - protein, 494 aa, Artificial Sequence
  Synthetic Peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 140 - protein, 982 aa, Artificial Sequence
  Synthetic Peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - protein, 982 aa, Artificial Sequence
  Synthetic Peptide
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 142 - protein, 5 aa, Artificial Sequence
  Synthetic Peptide
SYGMH

SEQ ID NO: 143 - protein, 17 aa, Artificial Sequence
  Synthetic Peptide
FIWYEGSNKYYAESVKD

SEQ ID NO: 144 - protein, 16 aa, Artificial Sequence
  Synthetic Peptide
RAGIIGTIGYYYGMDV

SEQ ID NO: 145 - protein, 11 aa, Artificial Sequence
  Synthetic Peptide
SGDRLGEKYTS

SEQ ID NO: 146 - protein, 7 aa, Artificial Sequence
  Synthetic Peptide
QDTKRPS

SEQ ID NO: 147 - protein, 9 aa, Artificial Sequence
  Synthetic Peptide
QAWESSTVV

SEQ ID NO: 148 - protein, 125 aa, Artificial Sequence
  Synthetic Peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSS

SEQ ID NO: 149 - protein, 125 aa, Artificial Sequence
  Synthetic Peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSS

SEQ ID NO: 150 - protein, 107 aa, Artificial Sequence
  Synthetic Peptide
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLS

SEQ ID NO: 151 - protein, 106 aa, Artificial Sequence
  Synthetic Peptide
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 152 - protein, 247 aa, Artificial Sequence
  Synthetic Peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLS

SEQ ID NO: 153 - protein, 246 aa, Artificial Sequence
  Synthetic Peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 154 - protein, 507 aa, Artificial Sequence
  Synthetic Peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 155 - protein, 501 aa, Artificial Sequence
  Synthetic Peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 156 - protein, 989 aa, Artificial Sequence
  Synthetic Peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 987 aa, Artificial Sequence
  Synthetic Peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 989 aa, Artificial Sequence
  Synthetic Peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 987 aa, Artificial Sequence
  Synthetic Peptide
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 7 aa, Artificial Sequence
  Synthetic Peptide
NARMGVS

SEQ ID NO: 161 - protein, 16 aa, Artificial Sequence
  Synthetic Peptide
HIFSNDEKSYSTSLKN

SEQ ID NO: 162 - protein, 14 aa, Artificial Sequence
  Synthetic Peptide
IVGYGSGWYGFFDY

SEQ ID NO: 163 - protein, 11 aa, Artificial Sequence
  Synthetic Peptide
RASQGIRNDLG

SEQ ID NO: 164 - protein, 7 aa, Artificial Sequence
  Synthetic Peptide
AASTLQS

SEQ ID NO: 165 - protein, 9 aa, Artificial Sequence
  Synthetic Peptide
LQHNSYPLT

SEQ ID NO: 166 - protein, 124 aa, Artificial Sequence
  Synthetic Peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSS

SEQ ID NO: 167 - protein, 107 aa, Artificial Sequence
  Synthetic Peptide
DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIK

SEQ ID NO: 168 - protein, 246 aa, Artificial Sequence
  Synthetic Peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIK

SEQ ID NO: 169 - protein, 501 aa, Artificial Sequence
  Synthetic Peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 170 - protein, 989 aa, Artificial Sequence
  Synthetic Peptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 5 aa, Artificial Sequence
  Synthetic Peptide
SYYWS

SEQ ID NO: 172 - protein, 16 aa, Artificial Sequence
  Synthetic Peptide
YVYYSGTTNYNPSLKS

SEQ ID NO: 173 - protein, 10 aa, Artificial Sequence
  Synthetic Peptide
IAVTGFYFDY

SEQ ID NO: 174 - protein, 12 aa, Artificial Sequence
  Synthetic Peptide
RASQRVNNNYLA

SEQ ID NO: 175 - protein, 7 aa, Artificial Sequence
  Synthetic Peptide
GASSRAT

SEQ ID NO: 176 - protein, 9 aa, Artificial Sequence
  Synthetic Peptide
QQYDRSPLT

SEQ ID NO: 177 - protein, 118 aa, Artificial Sequence
  Synthetic Peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSS

SEQ ID NO: 178 - protein, 108 aa, Artificial Sequence
  Synthetic Peptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIK

SEQ ID NO: 179 - protein, 241 aa, Artificial Sequence
  Synthetic Peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIK

SEQ ID NO: 180 - protein, 496 aa, Artificial Sequence
  Synthetic Peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 181 - protein, 982 aa, Artificial Sequence
  Synthetic Peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 5 aa, Artificial Sequence
  Synthetic Peptide
SYGMH

SEQ ID NO: 183 - protein, 17 aa, Artificial Sequence
  Synthetic Peptide
VISYEGSNKYYAESVKG

SEQ ID NO: 184 - protein, 13 aa, Artificial Sequence
  Synthetic Peptide
DRGTIFGNYGLEV

SEQ ID NO: 185 - protein, 16 aa, Artificial Sequence
  Synthetic Peptide
RSSQSLLHKNAFNYLD

SEQ ID NO: 186 - protein, 7 aa, Artificial Sequence
  Synthetic Peptide
LGSNRAS

SEQ ID NO: 187 - protein, 18 aa, Artificial Sequence
  Synthetic Peptide
MQALQTPFTMQALQTPFT

SEQ ID NO: 188 - protein, 122 aa, Artificial Sequence
  Synthetic Peptide
QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 189 - protein, 112 aa, Artificial Sequence
  Synthetic Peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIK

SEQ ID NO: 190 - protein, 503 aa, Artificial Sequence
  Synthetic Peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 191 - protein, 991 aa, Artificial Sequence
  Synthetic Peptide
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 5 aa, Artificial Sequence
  Synthetic Peptide
NHIIH

SEQ ID NO: 193 - protein, 17 aa, Artificial Sequence
  Synthetic Peptide
YINPYPGYHAYNEKFQG

SEQ ID NO: 194 - protein, 12 aa, Artificial Sequence
  Synthetic Peptide
DGYYRDTDVLDY

SEQ ID NO: 195 - protein, 11 aa, Artificial Sequence
  Synthetic Peptide
QASQDISNYLN

SEQ ID NO: 196 - protein, 7 aa, Artificial Sequence
  Synthetic Peptide
YTSRLHT

SEQ ID NO: 197 - protein, 7 aa, Artificial Sequence
  Synthetic Peptide
YTSRLHT

SEQ ID NO: 198 - protein, 121 aa, Artificial Sequence
  Synthetic Peptide
QVQLVQSGAEVKKPGASVKVSCKASGYTFTNHIIHWVRQAPGQCLEWMGYINPYPGYHAYNEKFQGRATMTSDTSTSTVYMELSSLRSEDTAVYYCARDGYYRDTDVLDYWGQGTLVTVSS

SEQ ID NO: 199 - protein, 107 aa, Artificial Sequence
  Synthetic Peptide
DIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGCGTKLEIK

SEQ ID NO: 200 - protein, 243 aa, Artificial Sequence
  Synthetic Peptide
QVQLVQSGAEVKKPGASVKVSCKASGYTFTNHIIHWVRQAPGQCLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGCGTKLEIK

SEQ ID NO: 201 - protein, 986 aa, Artificial Sequence
  Synthetic Peptide
QVQLVQSGAEVKKPGASVKVSCKASGYTFTNHIIHWVRQAPGQCLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 504 aa, Artificial Sequence
  Synthetic Peptide
QVQLVQSGAEVKKPGASVKVSCKASGYTFTNHIIHWVRQAPGQCLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 203 - protein, 5 aa, Artificial Sequence
  Synthetic Peptide
DYYMY

SEQ ID NO: 204 - protein, 17 aa, Artificial Sequence
  Synthetic Peptide
IISDAGYYTYYSDIIKG

SEQ ID NO: 205 - protein, 12 aa, Artificial Sequence
  Synthetic Peptide
GFPLLRHGAMDY

SEQ ID NO: 206 - protein, 11 aa, Artificial Sequence
  Synthetic Peptide
KASQNVDANVA

SEQ ID NO: 207 - protein, 7 aa, Artificial Sequence
  Synthetic Peptide
SASYVYW

SEQ ID NO: 208 - protein, 9 aa, Artificial Sequence
  Synthetic Peptide
QQYDQQLIT

SEQ ID NO: 209 - protein, 121 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSS

SEQ ID NO: 210 - protein, 107 aa, Artificial Sequence
  Synthetic Peptide
DIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIK

SEQ ID NO: 211 - protein, 243 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIK

SEQ ID NO: 212 - protein, 498 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 213 - protein, 986 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 984 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 498 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 216 - protein, 986 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - protein, 984 aa, Artificial Sequence
  Synthetic Peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 5 aa, Artificial Sequence
  Synthetic Peptide
DYYMY

SEQ ID NO: 219 - protein, 17 aa, Artificial Sequence
  Synthetic Peptide
IISDGGYYTYYSDIIKG

SEQ ID NO: 220 - protein, 12 aa, Artificial Sequence
  Synthetic Peptide
GFPLLRHGAMDY

SEQ ID NO: 221 - protein, 11 aa, Artificial Sequence
  Synthetic Peptide
KASQNVDTNVA

SEQ ID NO: 222 - protein, 7 aa, Artificial Sequence
  Synthetic Peptide
SASYVYW

SEQ ID NO: 223 - protein, 9 aa, Artificial Sequence
  Synthetic Peptide
QQYDQQLIT

SEQ ID NO: 224 - protein, 121 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 225 - protein, 121 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSS

SEQ ID NO: 226 - protein, 107 aa, Artificial Sequence
  Synthetic Peptide
DIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIK

SEQ ID NO: 227 - protein, 107 aa, Artificial Sequence
  Synthetic Peptide
DIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 228 - protein, 243 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIK

SEQ ID NO: 229 - protein, 243 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 230 - protein, 498 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 231 - protein, 498 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 232 - protein, 986 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 986 aa, Artificial Sequence; identical to SEQ ID NO: 232
  Synthetic Peptide

SEQ ID NO: 234 - protein, 498 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 235 - protein, 986 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - protein, 984 aa, Artificial Sequence
  Synthetic Peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 986 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 984 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 986 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 984 aa, Artificial Sequence
  Synthetic Peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 5 aa, Artificial Sequence
  Synthetic Peptide
TYAMS

SEQ ID NO: 242 - protein, 17 aa, Artificial Sequence
  Synthetic Peptide
AISGSGGRTFYAESVEG

SEQ ID NO: 243 - protein, 11 aa, Artificial Sequence
  Synthetic Peptide
HDYSNYPYFDY

SEQ ID NO: 244 - protein, 12 aa, Artificial Sequence
  Synthetic Peptide
RASQSVRSTYLA

SEQ ID NO: 245 - protein, 7 aa, Artificial Sequence
  Synthetic Peptide
GASSRAT

SEQ ID NO: 246 - protein, 9 aa, Artificial Sequence
  Synthetic Peptide
QQYGDLPFT

SEQ ID NO: 247 - protein, 120 aa, Artificial Sequence
  Synthetic Peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 248 - protein, 108 aa, Artificial Sequence
  Synthetic Peptide
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 249 - protein, 243 aa, Artificial Sequence
  Synthetic Peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 250 - protein, 986 aa, Artificial Sequence
  Synthetic Peptide
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 5 aa, Artificial Sequence
  Synthetic Peptide
GYYMH

SEQ ID NO: 252 - protein, 17 aa, Artificial Sequence
  Synthetic Peptide
WINPNSGGTKYAQKFQG

SEQ ID NO: 253 - protein, 16 aa, Artificial Sequence
  Synthetic Peptide
DRITVAGTYYYYGMDV

SEQ ID NO: 254 - protein, 11 aa, Artificial Sequence
  Synthetic Peptide
RASQGVNNWLA

SEQ ID NO: 255 - protein, 7 aa, Artificial Sequence
  Synthetic Peptide
TASSLQS

SEQ ID NO: 256 - protein, 9 aa, Artificial Sequence
  Synthetic Peptide
QQANSFPIT

SEQ ID NO: 257 - protein, 125 aa, Artificial Sequence
  Synthetic Peptide
QVQLVQSGAEVKKPGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSS

SEQ ID NO: 258 - protein, 107 aa, Artificial Sequence
  Synthetic Peptide
DIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIK

SEQ ID NO: 259 - protein, 247 aa, Artificial Sequence
  Synthetic Peptide
QVQLVQSGAEVKKPGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIK

SEQ ID NO: 260 - protein, 502 aa, Artificial Sequence
  Synthetic Peptide
QVQLVQSGAEVKKPGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 261 - protein, 990 aa, Artificial Sequence
  Synthetic Peptide
QVQLVQSGAEVKKPGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 125 aa, Artificial Sequence
  Synthetic Peptide
QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSS

SEQ ID NO: 263 - protein, 107 aa, Artificial Sequence; identical to SEQ ID NO: 258
  Synthetic Peptide

SEQ ID NO: 264 - protein, 247 aa, Artificial Sequence
  Synthetic Peptide
QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIK

SEQ ID NO: 265 - protein, 502 aa, Artificial Sequence
  Synthetic Peptide
QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 266 - protein, 990 aa, Artificial Sequence
  Synthetic Peptide
QVQMVQSGAEVKKHGASVKVSCKASGYTFTGYYMHWVRQAPGQCLEWMGWINPNSGGTKYAQKFQGRVTMTRDTSISTAYMELSRLRSDDTAVYYCARDRITVAGTYYYYGMDVWGQGTTVTVSSGGGGSGGGGSGGGGSDIQMTQSPSSVSASVGDRVTITCRASQGVNNWLAWYQQKPGKAPKLLIYTASSLQSGVPSRFSGSGSGTDFTLTIRSLQPEDFATYYCQQANSFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - protein, 5 aa, Artificial Sequence
  Synthetic Peptide
NHGMH

SEQ ID NO: 268 - protein, 17 aa, Artificial Sequence
  Synthetic Peptide
GIWSEGSNKYYADAVKG

SEQ ID NO: 269 - protein, 12 aa, Artificial Sequence
  Synthetic Peptide
ATYTTGWSYFDY

SEQ ID NO: 270 - protein, 11 aa, Artificial Sequence
  Synthetic Peptide
SGDKLGDKYAS

SEQ ID NO: 271 - protein, 7 aa, Artificial Sequence
  Synthetic Peptide
QDAKRPS

SEQ ID NO: 272 - protein, 9 aa, Artificial Sequence
  Synthetic Peptide
QAFHQSTWV

SEQ ID NO: 273 - protein, 121 aa, Artificial Sequence
  Synthetic Peptide
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSS

SEQ ID NO: 274 - protein, 106 aa, Artificial Sequence
  Synthetic Peptide
SYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL

SEQ ID NO: 275 - protein, 985 aa, Artificial Sequence
  Synthetic Peptide
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 5 aa, Artificial Sequence
  Synthetic Peptide
NHAMH

SEQ ID NO: 277 - protein, 17 aa, Artificial Sequence
  Synthetic Peptide
GIWSEGSNKYYAESVKG

SEQ ID NO: 278 - protein, 12 aa, Artificial Sequence
  Synthetic Peptide
ATYTTGWSYFDY

SEQ ID NO: 279 - protein, 11 aa, Artificial Sequence
  Synthetic Peptide
SGDKLGDKYAS

SEQ ID NO: 280 - protein, 7 aa, Artificial Sequence
  Synthetic Peptide
QDRKRPS

SEQ ID NO: 281 - protein, 9 aa, Artificial Sequence
  Synthetic Peptide
QAYDASTWV

SEQ ID NO: 282 - protein, 121 aa, Artificial Sequence
  Synthetic Peptide
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSS

SEQ ID NO: 283 - protein, 106 aa, Artificial Sequence
  Synthetic Peptide
SYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVL

SEQ ID NO: 284 - protein, 985 aa, Artificial Sequence
  Synthetic Peptide
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 5 aa, Artificial Sequence
  Synthetic Peptide
GYYWS

SEQ ID NO: 286 - protein, 16 aa, Artificial Sequence
  Synthetic Peptide
DIDASGSTKYNPSLKS

SEQ ID NO: 287 - protein, 12 aa, Artificial Sequence
  Synthetic Peptide
KKYSTVWSYFDN

SEQ ID NO: 288 - protein, 12 aa, Artificial Sequence
  Synthetic Peptide
KKYSTVWSYFDN

SEQ ID NO: 289 - protein, 7 aa, Artificial Sequence
  Synthetic Peptide
QDRKRPS

SEQ ID NO: 290 - protein, 9 aa, Artificial Sequence
  Synthetic Peptide
QAWGSSTAV

SEQ ID NO: 291 - protein, 120 aa, Artificial Sequence
  Synthetic Peptide
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSS

SEQ ID NO: 292 - protein, 106 aa, Artificial Sequence
  Synthetic Peptide
SYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 293 - protein, 984 aa, Artificial Sequence
  Synthetic Peptide
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 5 aa, Artificial Sequence
  Synthetic Peptide
GYYWS

SEQ ID NO: 295 - protein, 16 aa, Artificial Sequence
  Synthetic Peptide
DIDYSGSTKYNPSLKS

SEQ ID NO: 296 - protein, 12 aa, Artificial Sequence
  Synthetic Peptide
KKYSTVWSYFDY

SEQ ID NO: 297 - protein, 11 aa, Artificial Sequence
  Synthetic Peptide
SGDKLGDKYAN

SEQ ID NO: 298 - protein, 7 aa, Artificial Sequence
  Synthetic Peptide
HDNKRPS

SEQ ID NO: 299 - protein, 9 aa, Artificial Sequence
  Synthetic Peptide
QAYGISSAV

SEQ ID NO: 300 - protein, 120 aa, Artificial Sequence
  Synthetic Peptide
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSS

SEQ ID NO: 301 - protein, 106 aa, Artificial Sequence
  Synthetic Peptide
SYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVL

SEQ ID NO: 302 - protein, 984 aa, Artificial Sequence
  Synthetic Peptide
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 5 aa, Artificial Sequence
  Synthetic Peptide
SYPIN

SEQ ID NO: 304 - protein, 16 aa, Artificial Sequence
  Synthetic Peptide
VIWTGGGTNYASSVKG

SEQ ID NO: 305 - protein, 15 aa, Artificial Sequence
  Synthetic Peptide
SRGVYDFDGRGAMDY

SEQ ID NO: 306 - protein, 17 aa, Artificial Sequence
  Synthetic Peptide
KSSQSLLYSSNQKNYFA

SEQ ID NO: 307 - protein, 7 aa, Artificial Sequence
  Synthetic Peptide
WASTRES

SEQ ID NO: 308 - protein, 9 aa, Artificial Sequence
  Synthetic Peptide
QQYYSYPYT

SEQ ID NO: 309 - protein, 123 aa, Artificial Sequence
  Synthetic Peptide
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSS

SEQ ID NO: 310 - protein, 113 aa, Artificial Sequence
  Synthetic Peptide
DIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIK

SEQ ID NO: 311 - protein, 251 aa, Artificial Sequence
  Synthetic Peptide
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIK

SEQ ID NO: 312 - protein, 506 aa, Artificial Sequence
  Synthetic Peptide
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 313 - protein, 994 aa, Artificial Sequence
  Synthetic Peptide
EVQLLESGGGLVQPGGSLRLSCAASGFSFSSYPINWVRQAPGKGLEWVGVIWTGGGTNYASSVKGRFTISRDNSKNTVYLQMNSLRAEDTAVYYCAKSRGVYDFDGRGAMDYWGQGTLVTVSSGGGGSGGGGSGGGGSDIVMTQSPDSLAVSLGERATINCKSSQSLLYSSNQKNYFAWYQQKPGQPPKLLIYWASTRESGVPDRFSGSGSGTDFTLTISSLQAEDVAVYYCQQYYSYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 15 aa, Artificial Sequence
  Synthetic Peptide
KASQSVDYDGDSYLN

SEQ ID NO: 315 - protein, 7 aa, Artificial Sequence
  Synthetic Peptide
DASNLVS

SEQ ID NO: 316 - protein, 9 aa, Artificial Sequence
  Synthetic Peptide
QQSTEDPWT

SEQ ID NO: 317 - protein, 5 aa, Artificial Sequence
  Synthetic Peptide
SYWMN

SEQ ID NO: 318 - protein, 17 aa, Artificial Sequence
  Synthetic Peptide
QIWPGDGDTNYNGKFKG

SEQ ID NO: 319 - protein, 15 aa, Artificial Sequence
  Synthetic Peptide
RETTTVGRYYYAMDY

SEQ ID NO: 320 - protein, 111 aa, Artificial Sequence
  Synthetic Peptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 321 - protein, 124 aa, Artificial Sequence
  Synthetic Peptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 322 - protein, 250 aa, Artificial Sequence
  Synthetic Peptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 323 - protein, 5 aa, Artificial Sequence
  Synthetic Peptide
RYTMH

SEQ ID NO: 324 - protein, 17 aa, Artificial Sequence
  Synthetic Peptide
YINPSRGYTNYNQKFKD

SEQ ID NO: 325 - protein, 10 aa, Artificial Sequence
  Synthetic Peptide
YYDDHYCLDY

SEQ ID NO: 326 - protein, 10 aa, Artificial Sequence
  Synthetic Peptide
RASSSVSYMN

SEQ ID NO: 327 - protein, 7 aa, Artificial Sequence
  Synthetic Peptide
DTSKVAS

SEQ ID NO: 328 - protein, 9 aa, Artificial Sequence
  Synthetic Peptide
QQWSSNPLT

SEQ ID NO: 329 - protein, 119 aa, Artificial Sequence
  Synthetic Peptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 330 - protein, 108 aa, Artificial Sequence
  Synthetic Peptide
VDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 331 - protein, 243 aa, Artificial Sequence
  Synthetic Peptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 332 - protein, 504 aa, Artificial Sequence
  Synthetic Peptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 333 - protein, 4 aa, Artificial Sequence
  Synthetic Peptide
GGGG

SEQ ID NO: 334 - protein, 5 aa, Artificial Sequence
  Synthetic Peptide
GGGGS

SEQ ID NO: 335 - protein, 5 aa, Artificial Sequence
  Synthetic Peptide
GGGGQ

SEQ ID NO: 336 - protein, 6 aa, Artificial Sequence
  Synthetic Peptide
PGGGGS

SEQ ID NO: 337 - protein, 6 aa, Artificial Sequence
  Synthetic Peptide
PGGDGS

SEQ ID NO: 338 - protein, 6 aa, Artificial Sequence
  Synthetic Peptide
SGGGGS

SEQ ID NO: 339 - protein, 9 aa, Artificial Sequence
  Synthetic Peptide
GGGGSGGGS

SEQ ID NO: 340 - protein, 10 aa, Artificial Sequence
  Synthetic Peptide
GGGGSGGGGS

SEQ ID NO: 341 - protein, 15 aa, Artificial Sequence
  Synthetic Peptide
GGGGSGGGGSGGGGS

SEQ ID NO: 342 - protein, 6 aa, Artificial Sequence
  Synthetic Peptide
  X (1)..(4)
  misc_feature (6)..(6): Xaa can be any naturally occurring amino acid
GGGGSX

SEQ ID NO: 343 - protein, 6 aa, Artificial Sequence
  Synthetic Peptide
HHHHHH

SEQ ID NO: 344 - protein, 484 aa, Artificial Sequence
  Synthetic Peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 482 aa, Artificial Sequence
  Synthetic Peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - protein, 5 aa, Artificial Sequence
  Synthetic Peptide
NARMG

SEQ ID NO: 347 - protein, 19 aa, Artificial Sequence
  Synthetic Peptide
RIKSKTEGGTRDYAAPVKG

SEQ ID NO: 348 - protein, 4 aa, Artificial Sequence
  Synthetic Peptide
YSGV

SEQ ID NO: 349 - protein, 17 aa, Artificial Sequence
  Synthetic Peptide
KSSQSVLYSSNNKNYLA

SEQ ID NO: 350 - protein, 7 aa, Artificial Sequence
  Synthetic Peptide
WASTRES

SEQ ID NO: 351 - protein, 9 aa, Artificial Sequence
  Synthetic Peptide
QQYYSIPIT

SEQ ID NO: 352 - protein, 115 aa, Artificial Sequence; identical to SEQ ID NO: 13
  Synthetic Peptide

SEQ ID NO: 353 - protein, 114 aa, Artificial Sequence; identical to SEQ ID NO: 14
  Synthetic Peptide

SEQ ID NO: 354 - protein, 445 aa, Artificial Sequence
  Synthetic Peptide
EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 220 aa, Artificial Sequence; identical to SEQ ID NO: 16
  Synthetic Peptide

SEQ ID NO: 356 - protein, 5 aa, Artificial Sequence
  Synthetic Peptide
NARMG

SEQ ID NO: 357 - protein, 19 aa, Artificial Sequence
  Synthetic Peptide
RIKSKTEGGTRDYAAPVKG

SEQ ID NO: 358 - protein, 4 aa, Artificial Sequence
  Synthetic Peptide
YSGV

SEQ ID NO: 359 - protein, 17 aa, Artificial Sequence
  Synthetic Peptide
KSSQSVLYSSNNKNYLA

SEQ ID NO: 360 - protein, 7 aa, Artificial Sequence
  Synthetic Peptide
WASTRES

SEQ ID NO: 361 - protein, 9 aa, Artificial Sequence
  Synthetic Peptide
QQYYSIPIT

SEQ ID NO: 362 - protein, 115 aa, Artificial Sequence; identical to SEQ ID NO: 13
  Synthetic Peptide

SEQ ID NO: 363 - protein, 114 aa, Artificial Sequence
  Synthetic Peptide
DIVMTQSPDSLAVSLGERATINCKSSQSVLYSSNNKNYLAWYQQKPGQPPKLLISWASTRESGVPDRFSGSGSGTDFTLTINSLQAEDVAVYYCQQYYSIPITFGGGTKVEIKR

SEQ ID NO: 364 - protein, 445 aa, Artificial Sequence; identical to SEQ ID NO: 354
  Synthetic Peptide

SEQ ID NO: 365 - protein, 220 aa, Artificial Sequence
  Synthetic Peptide
DIVMTQSPDSLAVSLGERATINCKSSQSVLYSSNNKNYLAWYQQKPGQPPKLLISWASTRESGVPDRFSGSGSGTDFTLTINSLQAEDVAVYYCQQYYSIPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - protein, 5 aa, Artificial Sequence
  Synthetic Peptide
NYGMH

SEQ ID NO: 367 - protein, 17 aa, Artificial Sequence
  Synthetic Peptide
VISYDGSNKFYIRSVKG

SEQ ID NO: 368 - protein, 9 aa, Artificial Sequence
  Synthetic Peptide
AGGIGRFDY

SEQ ID NO: 369 - protein, 16 aa, Artificial Sequence
  Synthetic Peptide
KAAQSLLHSDGKTYLF

SEQ ID NO: 370 - protein, 7 aa, Artificial Sequence
  Synthetic Peptide
EVSNRFS

SEQ ID NO: 371 - protein, 9 aa, Artificial Sequence
  Synthetic Peptide
MQTLKLPLT

SEQ ID NO: 372 - protein, 118 aa, Artificial Sequence
  Synthetic Peptide
QVQLVESGGGVVQPGRSLRLSCAASGFTFSNYGMHWVRQAPGKGLEWVAVISYDGSNKFYIRSVKGRFTISRDNSKNTLYLQMNSLRAEDTAVYYCARAGGIGRFDYWGQGTLVTVSS

SEQ ID NO: 373 - protein, 113 aa, Artificial Sequence
  Synthetic Peptide
DIVMTQTPLSLSVTPGQPASISCKAAQSLLHSDGKTYLFWYLQKPGQSPQLLIYEVSNRFSGVPDRFSGSGSGTDFTLKISRVEAEDVGVYYCMQTLKLPLTFGGGTKVEIKR

SEQ ID NO: 374 - protein, 448 aa, Artificial Sequence
  Synthetic Peptide
QVQLVESGGGVVQPGRSLRLSCAASGFTFSNYGMHWVRQAPGKGLEWVAVISYDGSNKFYIRSVKGRFTISRDNSKNTLYLQMNSLRAEDTAVYYCARAGGIGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - protein, 219 aa, Artificial Sequence
  Synthetic Peptide
DIVMTQTPLSLSVTPGQPASISCKAAQSLLHSDGKTYLFWYLQKPGQSPQLLIYEVSNRFSGVPDRFSGSGSGTDFTLKISRVEAEDVGVYYCMQTLKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - protein, 5 aa, Artificial Sequence
  Synthetic Peptide
NYGMH

SEQ ID NO: 377 - protein, 17 aa, Artificial Sequence
  Synthetic Peptide
VISYDGSNKFYLKSVKG

SEQ ID NO: 378 - protein, 9 aa, Artificial Sequence
  Synthetic Peptide
AGGIGRFDY

SEQ ID NO: 379 - protein, 16 aa, Artificial Sequence
  Synthetic Peptide
KASQSLLHSDGKTYLF

SEQ ID NO: 380 - protein, 7 aa, Artificial Sequence
  Synthetic Peptide
EVSNRFS

SEQ ID NO: 381 - protein, 9 aa, Artificial Sequence
  Synthetic Peptide
MQTLKLPLT

SEQ ID NO: 382 - protein, 118 aa, Artificial Sequence
  Synthetic Peptide
QVQLVESGGGVVQPGRSLRLSCAASGFTFSNYGMHWVRQAPGKGLEWVAVISYDGSNKFYLKSVKGRFTISRDNSKNTLYLQMNSLRAEDTAVYYCARAGGIGRFDYWGQGTLVTVSS

SEQ ID NO: 383 - protein, 113 aa, Artificial Sequence
  Synthetic Peptide
DIVMTQTPLSLSVTPGQPASISCKASQSLLHSDGKTYLFWYLQKPGQSPQLLIYEVSNRFSGVPDRFSGSGSGTDFTLKISRVEAEDVGVYYCMQTLKLPLTFGGGTKVEIKR

SEQ ID NO: 384 - protein, 448 aa, Artificial Sequence
  Synthetic Peptide
QVQLVESGGGVVQPGRSLRLSCAASGFTFSNYGMHWVRQAPGKGLEWVAVISYDGSNKFYLKSVKGRFTISRDNSKNTLYLQMNSLRAEDTAVYYCARAGGIGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 219 aa, Artificial Sequence
  Synthetic Peptide
DIVMTQTPLSLSVTPGQPASISCKASQSLLHSDGKTYLFWYLQKPGQSPQLLIYEVSNRFSGVPDRFSGSGSGTDFTLKISRVEAEDVGVYYCMQTLKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 5 aa, Artificial Sequence
  Synthetic Peptide
NAWMS

SEQ ID NO: 387 - protein, 19 aa, Artificial Sequence
  Synthetic Peptide
RIKRRTDGGTTDYAAPVKD

SEQ ID NO: 388 - protein, 11 aa, Artificial Sequence
  Synthetic Peptide
VTMVRGVIADY

SEQ ID NO: 389 - protein, 12 aa, Artificial Sequence
  Synthetic Peptide
RASQSVSSGSLA

SEQ ID NO: 390 - protein, 7 aa, Artificial Sequence
  Synthetic Peptide
GASSRAT

SEQ ID NO: 391 - protein, 8 aa, Artificial Sequence
  Synthetic Peptide
QQYGSSRT

SEQ ID NO: 392 - protein, 122 aa, Artificial Sequence
  Synthetic Peptide
EVQLVESGGGLVKPGGSLRLSCAASGFIFSNAWMSWVRQAPGKGLEWVARIKRRTDGGTTDYAAPVKDRFTISRDDSKNTLFLQMNSLKTEDTAVYYCTTVTMVRGVIADYWGQGTLVTVSS

SEQ ID NO: 393 - protein, 108 aa, Artificial Sequence
  Synthetic Peptide
EIVLTQSPGTLSLSPGERATLSCRASQSVSSGSLAWYQQKLGQAPRLLIYGASSRATGIPDRFSGSGSGTDFTLTISSLEPEDFAVYYCQQYGSSRTFGQGTKVELKR

SEQ ID NO: 394 - protein, 452 aa, Artificial Sequence
  Synthetic Peptide
EVQLVESGGGLVKPGGSLRLSCAASGFIFSNAWMSWVRQAPGKGLEWVARIKRRTDGGTTDYAAPVKDRFTISRDDSKNTLFLQMNSLKTEDTAVYYCTTVTMVRGVIADYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 395 - protein, 214 aa, Artificial Sequence
  Synthetic Peptide
EIVLTQSPGTLSLSPGERATLSCRASQSVSSGSLAWYQQKLGQAPRLLIYGASSRATGIPDRFSGSGSGTDFTLTISSLEPEDFAVYYCQQYGSSRTFGQGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 5 aa, Artificial Sequence
  Synthetic Peptide
NAWMS

SEQ ID NO: 397 - protein, 19 aa, Artificial Sequence
  Synthetic Peptide
RIKRKTDGGTTDYAAPVKG

SEQ ID NO: 398 - protein, 11 aa, Artificial Sequence
  Synthetic Peptide
VTLVRGIIFDY

SEQ ID NO: 399 - protein, 12 aa, Artificial Sequence
  Synthetic Peptide
RVSQSVSSSQLA

SEQ ID NO: 400 - protein, 7 aa, Artificial Sequence
  Synthetic Peptide
GASSRAT

SEQ ID NO: 401 - protein, 8 aa, Artificial Sequence
  Synthetic Peptide
QQYGNSRT

SEQ ID NO: 402 - protein, 122 aa, Artificial Sequence
  Synthetic Peptide
EVQLVESGGGLVKPGGSLRLSCAASGFIFSNAWMSWVRQAPGKGLEWVGRIKRKTDGGTTDYAAPVKGRFTISRDDSKNTLYLLMNSLKIEDTAVYYCTVVTLVRGIIFDYWGQGTLVTVSS

SEQ ID NO: 403 - protein, 108 aa, Artificial Sequence
  Synthetic Peptide
EIVLTQSPGTLSLSPGESATLSCRVSQSVSSSQLAWYQQKPGQAPRLLIYGASSRATGIPDRFSGSGSGTDFTLTISRLEPEDFAVYYCQQYGNSRTFGQGTKVEIKR

SEQ ID NO: 404 - protein, 452 aa, Artificial Sequence
  Synthetic Peptide
EVQLVESGGGLVKPGGSLRLSCAASGFIFSNAWMSWVRQAPGKGLEWVGRIKRKTDGGTTDYAAPVKGRFTISRDDSKNTLYLLMNSLKIEDTAVYYCTVVTLVRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 214 aa, Artificial Sequence
  Synthetic Peptide
EIVLTQSPGTLSLSPGESATLSCRVSQSVSSSQLAWYQQKPGQAPRLLIYGASSRATGIPDRFSGSGSGTDFTLTISRLEPEDFAVYYCQQYGNSRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 5 aa, Artificial Sequence
  Synthetic Peptide
NAWLQ

SEQ ID NO: 407 - protein, 19 aa, Artificial Sequence
  Synthetic Peptide
RIKRKTDQLTTDYAAPVKG

SEQ ID NO: 408 - protein, 11 aa, Artificial Sequence
  Synthetic Peptide
VTRSRGIIFDY

SEQ ID NO: 409 - protein, 12 aa, Artificial Sequence
  Synthetic Peptide
RVSQSVSSSQLA

SEQ ID NO: 410 - protein, 7 aa, Artificial Sequence
  Synthetic Peptide
GASSRAT

SEQ ID NO: 411 - protein, 8 aa, Artificial Sequence
  Synthetic Peptide
QQYGNPRT

SEQ ID NO: 412 - protein, 122 aa, Artificial Sequence
  Synthetic Peptide
EVQLVESGGGLVKPGGSLRLSCAASGFIFSNAWLQWVRQAPGKGLEWVGRIKRKTDQLTTDYAAPVKGRFTISRDDSKNTLYLLMNSLKIEDTAVYYCTVVTRSRGIIFDYWGQGTLVTVSS

SEQ ID NO: 413 - protein, 108 aa, Artificial Sequence
  Synthetic Peptide
EIVLTQSPGTLSLSPGESATLSCRVSQSVSSSQLAWYQQKPGQAPRLLIYGASSRATGIPDRFSGSGSGTDFTLTISRLEPEDFAVYYCQQYGNPRTFGQGTKVEIKR

SEQ ID NO: 414 - protein, 452 aa, Artificial Sequence
  Synthetic Peptide
EVQLVESGGGLVKPGGSLRLSCAASGFIFSNAWLQWVRQAPGKGLEWVGRIKRKTDQLTTDYAAPVKGRFTISRDDSKNTLYLLMNSLKIEDTAVYYCTVVTRSRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 214 aa, Artificial Sequence
  Synthetic Peptide
EIVLTQSPGTLSLSPGESATLSCRVSQSVSSSQLAWYQQKPGQAPRLLIYGASSRATGIPDRFSGSGSGTDFTLTISRLEPEDFAVYYCQQYGNPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 5 aa, Artificial Sequence
  Synthetic Peptide
NAWLQ

SEQ ID NO: 417 - protein, 19 aa, Artificial Sequence
  Synthetic Peptide
RIKRKTDASTTDYAAPVKG

SEQ ID NO: 418 - protein, 11 aa, Artificial Sequence
  Synthetic Peptide
VTRSRGIIFDY

SEQ ID NO: 419 - protein, 12 aa, Artificial Sequence
  Synthetic Peptide
RVSQSVSSSQLA

SEQ ID NO: 420 - protein, 7 aa, Artificial Sequence
  Synthetic Peptide
GASSRAT

SEQ ID NO: 421 - protein, 8 aa, Artificial Sequence
  Synthetic Peptide
QQYGNPRT

SEQ ID NO: 422 - protein, 122 aa, Artificial Sequence
  Synthetic Peptide
EVQLVESGGGLVKPGGSLRLSCAASGFIFSNAWLQWVRQAPGKGLEWVGRIKRKTDASTTDYAAPVKGRFTISRDDSKNTLYLLMNSLKIEDTAVYYCTVVTRSRGIIFDYWGQGTLVTVSS

SEQ ID NO: 423 - protein, 108 aa, Artificial Sequence; identical to SEQ ID NO: 413
  Synthetic Peptide

SEQ ID NO: 424 - protein, 452 aa, Artificial Sequence
  Synthetic Peptide
EVQLVESGGGLVKPGGSLRLSCAASGFIFSNAWLQWVRQAPGKGLEWVGRIKRKTDASTTDYAAPVKGRFTISRDDSKNTLYLLMNSLKIEDTAVYYCTVVTRSRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - protein, 214 aa, Artificial Sequence; identical to SEQ ID NO: 415
  Synthetic Peptide

SEQ ID NO: 426 - protein, 5 aa, Artificial Sequence
  Synthetic Peptide
SYGMH

SEQ ID NO: 427 - protein, 17 aa, Artificial Sequence
  Synthetic Peptide
VISYDGSNKYYADSVKG

SEQ ID NO: 428 - protein, 11 aa, Artificial Sequence
  Synthetic Peptide
GRYFDWFLFDY

SEQ ID NO: 429 - protein, 16 aa, Artificial Sequence
  Synthetic Peptide
KSSQSLLHSDGKTYLF

SEQ ID NO: 430 - protein, 7 aa, Artificial Sequence
  Synthetic Peptide
EVSNRFS

SEQ ID NO: 431 - protein, 9 aa, Artificial Sequence
  Synthetic Peptide
MQSLRLPLT

SEQ ID NO: 432 - protein, 120 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWFLFDYWGQGTLVTVSS

SEQ ID NO: 433 - protein, 113 aa, Artificial Sequence
  Synthetic Peptide
DTVMTQTPLSLSVTPGQPASISCKSSQSLLHSDGKTYLFWYLQKPGQPPQLLISEVSNRFSGVPDRFSGSGSGTDFTLKISRVEAEDVGFYYCMQSLRLPLTFGGGTKVEIKR

SEQ ID NO: 434 - protein, 450 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 219 aa, Artificial Sequence
  Synthetic Peptide
DTVMTQTPLSLSVTPGQPASISCKSSQSLLHSDGKTYLFWYLQKPGQPPQLLISEVSNRFSGVPDRFSGSGSGTDFTLKISRVEAEDVGFYYCMQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 436 - protein, 5 aa, Artificial Sequence
  Synthetic Peptide
SYGMH

SEQ ID NO: 437 - protein, 17 aa, Artificial Sequence
  Synthetic Peptide
VISYDGSNKYYADSVKG

SEQ ID NO: 438 - protein, 11 aa, Artificial Sequence
  Synthetic Peptide
GRYFDWTLFDY

SEQ ID NO: 439 - protein, 16 aa, Artificial Sequence
  Synthetic Peptide
KSSQSLLHRDGKTYLF

SEQ ID NO: 440 - protein, 7 aa, Artificial Sequence
  Synthetic Peptide
EVSNRFS

SEQ ID NO: 441 - protein, 9 aa, Artificial Sequence
  Synthetic Peptide
MQSLRLPLT

SEQ ID NO: 442 - protein, 120 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWTLFDYWGQGTLVTVSS

SEQ ID NO: 443 - protein, 113 aa, Artificial Sequence
  Synthetic Peptide
DTVMTQTPLSLSVTPGQPASISCKSSQSLLHRDGKTYLFWYLQKPGQPPQLLIYEVSNRFSGVPDRFSGSGSGTDFTLKISRVEAEDVGVYYCMQSLRLPLTFGGGTKVEIKR

SEQ ID NO: 444 - protein, 450 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWTLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 445 - protein, 219 aa, Artificial Sequence
  Synthetic Peptide
DTVMTQTPLSLSVTPGQPASISCKSSQSLLHRDGKTYLFWYLQKPGQPPQLLIYEVSNRFSGVPDRFSGSGSGTDFTLKISRVEAEDVGVYYCMQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 5 aa, Artificial Sequence
  Synthetic Peptide
SYPMH

SEQ ID NO: 447 - protein, 17 aa, Artificial Sequence
  Synthetic Peptide
VISYDGSNKYYADSVKG

SEQ ID NO: 448 - protein, 11 aa, Artificial Sequence
  Synthetic Peptide
GRYFDWTLFDY

SEQ ID NO: 449 - protein, 16 aa, Artificial Sequence
  Synthetic Peptide
KSSQSLLHSDGKTYLF

SEQ ID NO: 450 - protein, 7 aa, Artificial Sequence
  Synthetic Peptide
LRSNRFS

SEQ ID NO: 451 - protein, 9 aa, Artificial Sequence
  Synthetic Peptide
MQSLRLPLT

SEQ ID NO: 452 - protein, 120 aa, Artificial Sequence
  Synthetic Peptide
QVQLVESGGGVVQPGRSLRLSCAASGFTFSSYPMHWVRQAPGKGLEWVAVISYDGSNKYYADSVKGRFTISRDNSKNTLYLQMNSLRAEDTAVYYCARGRYFDWTLFDYWGQGTLVTVSS

SEQ ID NO: 453 - protein, 113 aa, Artificial Sequence
  Synthetic Peptide
DTVMTQTPLSLSVTPGQPASISCKSSQSLLHSDGKTYLFWYLQKPGQPPQLLIYLRSNRFSGVPDRFSGSGSGTDFTLKISRVEAEDVGVYYCMQSLRLPLTFGGGTKVEIKR

SEQ ID NO: 454 - protein, 450 aa, Artificial Sequence
  Synthetic Peptide
QVQLVESGGGVVQPGRSLRLSCAASGFTFSSYPMHWVRQAPGKGLEWVAVISYDGSNKYYADSVKGRFTISRDNSKNTLYLQMNSLRAEDTAVYYCARGRYFDWTLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - protein, 219 aa, Artificial Sequence
  Synthetic Peptide
DTVMTQTPLSLSVTPGQPASISCKSSQSLLHSDGKTYLFWYLQKPGQPPQLLIYLRSNRFSGVPDRFSGSGSGTDFTLKISRVEAEDVGVYYCMQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - protein, 5 aa, Artificial Sequence
  Synthetic Peptide
SYGMH

SEQ ID NO: 457 - protein, 17 aa, Artificial Sequence
  Synthetic Peptide
VISYDGSNKYYSRSVKG

SEQ ID NO: 458 - protein, 11 aa, Artificial Sequence
  Synthetic Peptide
GRYFDWFLFDY

SEQ ID NO: 459 - protein, 16 aa, Artificial Sequence
  Synthetic Peptide
KSSQSLLHSDGKTYLF

SEQ ID NO: 460 - protein, 7 aa, Artificial Sequence
  Synthetic Peptide
LSSNRFS

SEQ ID NO: 461 - protein, 9 aa, Artificial Sequence
  Synthetic Peptide
MQSLRLPLT

SEQ ID NO: 462 - protein, 129 aa, Artificial Sequence
  Synthetic Peptide
MQSLRLPLTQVQLVESGGGVVQPGRSLRLSCAASGFTFSSYGMHWVRQAPGKGLEWVAVISYDGSNKYYSRSVKGRFTISRDNSKNTLYLQMNSLRAEDTAVYYCARGRYFDWFLFDYWGQGTLVTVSS

SEQ ID NO: 463 - protein, 113 aa, Artificial Sequence
  Synthetic Peptide
DTVMTQTPLSLSVTPGQPASISCKSSQSLLHSDGKTYLFWYLQKPGQPPQLLIYLSSNRFSGVPDRFSGSGSGTDFTLKISRVEAEDVGVYYCMQSLRLPLTFGGGTKVEIKR

SEQ ID NO: 464 - protein, 450 aa, Artificial Sequence
  Synthetic Peptide
QVQLVESGGGVVQPGRSLRLSCAASGFTFSSYGMHWVRQAPGKGLEWVAVISYDGSNKYYSRSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 465 - protein, 219 aa, Artificial Sequence
  Synthetic Peptide
DTVMTQTPLSLSVTPGQPASISCKSSQSLLHSDGKTYLFWYLQKPGQPPQLLIYLSSNRFSGVPDRFSGSGSGTDFTLKISRVEAEDVGVYYCMQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 5 aa, Artificial Sequence
  Synthetic Peptide
SYAMH

SEQ ID NO: 467 - protein, 17 aa, Artificial Sequence
  Synthetic Peptide
VISYDGSNKYYADSVKG

SEQ ID NO: 468 - protein, 11 aa, Artificial Sequence
  Synthetic Peptide
GRYFDWFLFDY

SEQ ID NO: 469 - protein, 16 aa, Artificial Sequence
  Synthetic Peptide
KSSQSLLHSDGKTYLF

SEQ ID NO: 470 - protein, 7 aa, Artificial Sequence
  Synthetic Peptide
LTSNRFS

SEQ ID NO: 471 - protein, 9 aa, Artificial Sequence
  Synthetic Peptide
MQSLRLPLT

SEQ ID NO: 472 - protein, 120 aa, Artificial Sequence
  Synthetic Peptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYFDWFLFDYWGQGTLVTVSS

SEQ ID NO: 473 - protein, 113 aa, Artificial Sequence
  Synthetic Peptide
DTVMTQTPLSLSVTPGQPASISCKSSQSLLHSDGKTYLFWYLQKPGQPPQLLIYLTSNRFSGVPDRFSGSGSGTDFTLKISRVEAEDVGVYYCMQSLRLPLTFGGGTKVEIKR

SEQ ID NO: 474 - protein, 450 aa, Artificial Sequence
  Synthetic Peptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 219 aa, Artificial Sequence
  Synthetic Peptide
DTVMTQTPLSLSVTPGQPASISCKSSQSLLHSDGKTYLFWYLQKPGQPPQLLIYLTSNRFSGVPDRFSGSGSGTDFTLKISRVEAEDVGVYYCMQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - protein, 5 aa, Artificial Sequence
  Synthetic Peptide
SYPVH

SEQ ID NO: 477 - protein, 17 aa, Artificial Sequence
  Synthetic Peptide
VISYDGSNKYYADSVKG

SEQ ID NO: 478 - protein, 11 aa, Artificial Sequence
  Synthetic Peptide
GRYFDWFLFDY

SEQ ID NO: 479 - protein, 16 aa, Artificial Sequence
  Synthetic Peptide
KSSQSLLHSDGKTYLF

SEQ ID NO: 480 - protein, 7 aa, Artificial Sequence
  Synthetic Peptide
LTSNRFS

SEQ ID NO: 481 - protein, 9 aa, Artificial Sequence
  Synthetic Peptide
MQSLRLPLT

SEQ ID NO: 482 - protein, 120 aa, Artificial Sequence
  Synthetic Peptide
QVQLVESGGGVVQPGRSLRLSCAASGFTFSSYPVHWVRQAPGKGLEWVAVISYDGSNKYYADSVKGRFTISRDNSKNTLYLQMNSLRAEDTAVYYCARGRYFDWFLFDYWGQGTLVTVSS

SEQ ID NO: 483 - protein, 113 aa, Artificial Sequence; identical to SEQ ID NO: 473
  Synthetic Peptide

SEQ ID NO: 484 - protein, 450 aa, Artificial Sequence
  Synthetic Peptide
QVQLVESGGGVVQPGRSLRLSCAASGFTFSSYPVHWVRQAPGKGLEWVAVISYDGSNKYYADSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 219 aa, Artificial Sequence; identical to SEQ ID NO: 475
  Synthetic Peptide

SEQ ID NO: 486 - protein, 5 aa, Artificial Sequence
  Synthetic Peptide
SYGMH

SEQ ID NO: 487 - protein, 17 aa, Artificial Sequence
  Synthetic Peptide
VISYDGSNKYYADSVKG

SEQ ID NO: 488 - protein, 11 aa, Artificial Sequence
  Synthetic Peptide
GRYFDWTLFDY

SEQ ID NO: 489 - protein, 16 aa, Artificial Sequence
  Synthetic Peptide
KSSQSLLHRDARTYLF

SEQ ID NO: 490 - protein, 7 aa, Artificial Sequence
  Synthetic Peptide
EVSNRFS

SEQ ID NO: 491 - protein, 9 aa, Artificial Sequence
  Synthetic Peptide
LQSLRLPLT

SEQ ID NO: 492 - protein, 120 aa, Artificial Sequence; identical to SEQ ID NO: 442
  Synthetic Peptide

SEQ ID NO: 493 - protein, 113 aa, Artificial Sequence
  Synthetic Peptide
DTVMTQTPLSLSVTPGQPASISCKSSQSLLHRDARTYLFWYLQKPGQPPQLLIYEVSNRFSGVPDRFSGSGSGTDFTLKISRVEAEDVGVYYCLQSLRLPLTFGGGTKVEIKR

SEQ ID NO: 494 - protein, 450 aa, Artificial Sequence; identical to SEQ ID NO: 444
  Synthetic Peptide

SEQ ID NO: 495 - protein, 219 aa, Artificial Sequence
  Synthetic Peptide
DTVMTQTPLSLSVTPGQPASISCKSSQSLLHRDARTYLFWYLQKPGQPPQLLIYEVSNRFSGVPDRFSGSGSGTDFTLKISRVEAEDVGVYYCLQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 496 - protein, 5 aa, Artificial Sequence
  Synthetic Peptide
SYGMH

SEQ ID NO: 497 - protein, 17 aa, Artificial Sequence
  Synthetic Peptide
VISYDGSNKYYSRSVKG

SEQ ID NO: 498 - protein, 11 aa, Artificial Sequence
  Synthetic Peptide
GRYFDWFLFDY

SEQ ID NO: 499 - protein, 16 aa, Artificial Sequence
  Synthetic Peptide
KSSQSLLHSDARTYLF

SEQ ID NO: 500 - protein, 7 aa, Artificial Sequence
  Synthetic Peptide
LSSNRFS

SEQ ID NO: 501 - protein, 9 aa, Artificial Sequence
  Synthetic Peptide
LQSLRLPLT

SEQ ID NO: 502 - protein, 120 aa, Artificial Sequence
  Synthetic Peptide
QVQLVESGGGVVQPGRSLRLSCAASGFTFSSYGMHWVRQAPGKGLEWVAVISYDGSNKYYSRSVKGRFTISRDNSKNTLYLQMNSLRAEDTAVYYCARGRYFDWFLFDYWGQGTLVTVSS

SEQ ID NO: 503 - protein, 113 aa, Artificial Sequence
  Synthetic Peptide
DTVMTQTPLSLSVTPGQPASISCKSSQSLLHSDARTYLFWYLQKPGQPPQLLIYLSSNRFSGVPDRFSGSGSGTDFTLKISRVEAEDVGVYYCLQSLRLPLTFGGGTKVEIKR

SEQ ID NO: 504 - protein, 450 aa, Artificial Sequence; identical to SEQ ID NO: 464
  Synthetic Peptide

SEQ ID NO: 505 - protein, 219 aa, Artificial Sequence
  Synthetic Peptide
DTVMTQTPLSLSVTPGQPASISCKSSQSLLHSDARTYLFWYLQKPGQPPQLLIYLSSNRFSGVPDRFSGSGSGTDFTLKISRVEAEDVGVYYCLQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 506 - protein, 5 aa, Artificial Sequence
  Synthetic Peptide
SYPMH

SEQ ID NO: 507 - protein, 17 aa, Artificial Sequence
  Synthetic Peptide
VISYDGSNKYYADSVKG

SEQ ID NO: 508 - protein, 11 aa, Artificial Sequence
  Synthetic Peptide
GRYFDWTLFDY

SEQ ID NO: 509 - protein, 16 aa, Artificial Sequence
  Synthetic Peptide
KSSQSLLHSDARTYLF

SEQ ID NO: 510 - protein, 7 aa, Artificial Sequence
  Synthetic Peptide
LRSNRFS

SEQ ID NO: 511 - protein, 9 aa, Artificial Sequence
  Synthetic Peptide
LQSLRLPLT

SEQ ID NO: 512 - protein, 120 aa, Artificial Sequence; identical to SEQ ID NO: 452
  Synthetic Peptide

SEQ ID NO: 513 - protein, 113 aa, Artificial Sequence
  Synthetic Peptide
DTVMTQTPLSLSVTPGQPASISCKSSQSLLHSDARTYLFWYLQKPGQPPQLLIYLRSNRFSGVPDRFSGSGSGTDFTLKISRVEAEDVGVYYCLQSLRLPLTFGGGTKVEIKR

SEQ ID NO: 514 - protein, 450 aa, Artificial Sequence; identical to SEQ ID NO: 454
  Synthetic Peptide

SEQ ID NO: 515 - protein, 219 aa, Artificial Sequence
  Synthetic Peptide
DTVMTQTPLSLSVTPGQPASISCKSSQSLLHSDARTYLFWYLQKPGQPPQLLIYLRSNRFSGVPDRFSGSGSGTDFTLKISRVEAEDVGVYYCLQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - protein, 5 aa, Artificial Sequence
  Synthetic Peptide
SYAMH

SEQ ID NO: 517 - protein, 17 aa, Artificial Sequence
  Synthetic Peptide
VISYDGSNKYYADSVKG

SEQ ID NO: 518 - protein, 11 aa, Artificial Sequence
  Synthetic Peptide
GRYFDWFLFDY

SEQ ID NO: 519 - protein, 16 aa, Artificial Sequence
  Synthetic Peptide
KSSQSLLHSDARTYLF

SEQ ID NO: 520 - protein, 7 aa, Artificial Sequence
  Synthetic Peptide
LTSNRFS

SEQ ID NO: 521 - protein, 9 aa, Artificial Sequence
  Synthetic Peptide
LQSLRLPLT

SEQ ID NO: 522 - protein, 120 aa, Artificial Sequence; identical to SEQ ID NO: 472
  Synthetic Peptide

SEQ ID NO: 523 - protein, 113 aa, Artificial Sequence
  Synthetic Peptide
DTVMTQTPLSLSVTPGQPASISCKSSQSLLHSDARTYLFWYLQKPGQPPQLLIYLTSNRFSGVPDRFSGSGSGTDFTLKISRVEAEDVGVYYCLQSLRLPLTFGGGTKVEIKR

SEQ ID NO: 524 - protein, 450 aa, Artificial Sequence; identical to SEQ ID NO: 474
  Synthetic Peptide

SEQ ID NO: 525 - protein, 219 aa, Artificial Sequence
  Synthetic Peptide
DTVMTQTPLSLSVTPGQPASISCKSSQSLLHSDARTYLFWYLQKPGQPPQLLIYLTSNRFSGVPDRFSGSGSGTDFTLKISRVEAEDVGVYYCLQSLRLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 5 aa, Artificial Sequence
  Synthetic Peptide
SYVMH

SEQ ID NO: 527 - protein, 17 aa, Artificial Sequence
  Synthetic Peptide
VISYDGSSQYYTDSVKG

SEQ ID NO: 528 - protein, 11 aa, Artificial Sequence
  Synthetic Peptide
GRLATAILFDY

SEQ ID NO: 529 - protein, 16 aa, Artificial Sequence
  Synthetic Peptide
KSSQSLLYSDGKTYLF

SEQ ID NO: 530 - protein, 7 aa, Artificial Sequence
  Synthetic Peptide
EVSNRFS

SEQ ID NO: 531 - protein, 9 aa, Artificial Sequence
  Synthetic Peptide
MQSIKLPLT

SEQ ID NO: 532 - protein, 120 aa, Artificial Sequence
  Synthetic Peptide
QVQLVESGGGVVQPGRSLRLSCEASGFTFSSYVMHWVRQAPGKGLEWVSVISYDGSSQYYTDSVKGRFTISRDNSKNTLNLQMNSLRAEDTAVYYCVRGRLATAILFDYWGQGTLVTVSS

SEQ ID NO: 533 - protein, 113 aa, Artificial Sequence
  Synthetic Peptide
DILMTQTPLSLSVTPGQPASISCKSSQSLLYSDGKTYLFWYLQRPGQPPQLLIYEVSNRFSGVPDRFSGSGSGTDFTLKISRVEAEDVGIYYCMQSIKLPLTFGGGTKVEIKR

SEQ ID NO: 534 - protein, 450 aa, Artificial Sequence
  Synthetic Peptide
QVQLVESGGGVVQPGRSLRLSCEASGFTFSSYVMHWVRQAPGKGLEWVSVISYDGSSQYYTDSVKGRFTISRDNSKNTLNLQMNSLRAEDTAVYYCVRGRLATAILFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 535 - protein, 219 aa, Artificial Sequence
  Synthetic Peptide
DILMTQTPLSLSVTPGQPASISCKSSQSLLYSDGKTYLFWYLQRPGQPPQLLIYEVSNRFSGVPDRFSGSGSGTDFTLKISRVEAEDVGIYYCMQSIKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 5 aa, Artificial Sequence
  Synthetic Peptide
SYVMH

SEQ ID NO: 537 - protein, 17 aa, Artificial Sequence
  Synthetic Peptide
VISYDGSRQYYTDSVKG

SEQ ID NO: 538 - protein, 11 aa, Artificial Sequence
  Synthetic Peptide
GRLATSPLFDY

SEQ ID NO: 539 - protein, 16 aa, Artificial Sequence
  Synthetic Peptide
KSSQSLLYSDGKTYLF

SEQ ID NO: 540 - protein, 7 aa, Artificial Sequence
  Synthetic Peptide
EVSNRLS

SEQ ID NO: 541 - protein, 9 aa, Artificial Sequence
  Synthetic Peptide
MQSIKLPLT

SEQ ID NO: 542 - protein, 120 aa, Artificial Sequence
  Synthetic Peptide
QVQLVESGGGVVQPGRSLRLSCEASGFTFSSYVMHWVRQAPGKGLEWVSVISYDGSRQYYTDSVKGRFTISRDNSKNTLNLQMNSLRAEDTAVYYCVRGRLATSPLFDYWGQGTLVTVSS

SEQ ID NO: 543 - protein, 113 aa, Artificial Sequence
  Synthetic Peptide
DILMTQTPLSLSVTPGQPASISCKSSQSLLYSDGKTYLFWYLQRPGQPPQLLIYEVSNRLSGVPDRFSGSGSGTDFTLKISRVEAEDVGIYYCMQSIKLPLTFGGGTKVEIKR

SEQ ID NO: 544 - protein, 450 aa, Artificial Sequence
  Synthetic Peptide
QVQLVESGGGVVQPGRSLRLSCEASGFTFSSYVMHWVRQAPGKGLEWVSVISYDGSRQYYTDSVKGRFTISRDNSKNTLNLQMNSLRAEDTAVYYCVRGRLATSPLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - protein, 219 aa, Artificial Sequence
  Synthetic Peptide
DILMTQTPLSLSVTPGQPASISCKSSQSLLYSDGKTYLFWYLQRPGQPPQLLIYEVSNRLSGVPDRFSGSGSGTDFTLKISRVEAEDVGIYYCMQSIKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 546 - protein, 5 aa, Artificial Sequence
  Synthetic Peptide
SYVMH

SEQ ID NO: 547 - protein, 17 aa, Artificial Sequence
  Synthetic Peptide
VISYDGSRAYYTDSVKG

SEQ ID NO: 548 - protein, 11 aa, Artificial Sequence
  Synthetic Peptide
GRLATAIKLDY

SEQ ID NO: 549 - protein, 16 aa, Artificial Sequence
  Synthetic Peptide
KSSQSLLYSDGKTYLF

SEQ ID NO: 550 - protein, 7 aa, Artificial Sequence
  Synthetic Peptide
EVSNRFS

SEQ ID NO: 551 - protein, 9 aa, Artificial Sequence
  Synthetic Peptide
MQTLKLPLT

SEQ ID NO: 552 - protein, 120 aa, Artificial Sequence
  Synthetic Peptide
QVQLVESGGGVVQPGRSLRLSCEASGFTFSSYVMHWVRQAPGKGLEWVSVISYDGSRAYYTDSVKGRFTISRDNSKNTLNLQMNSLRAEDTAVYYCVRGRLATAIKLDYWGQGTLVTVSS

SEQ ID NO: 553 - protein, 113 aa, Artificial Sequence
  Synthetic Peptide
DILMTQTPLSLSVTPGQPASISCKSSQSLLYSDGKTYLFWYLQRPGQPPQLLIYEVSNRFSGVPDRFSGSGSGTDFTLKISRVEAEDVGIYYCMQTLKLPLTFGGGTKVEIKR

SEQ ID NO: 554 - protein, 450 aa, Artificial Sequence
  Synthetic Peptide
QVQLVESGGGVVQPGRSLRLSCEASGFTFSSYVMHWVRQAPGKGLEWVSVISYDGSRAYYTDSVKGRFTISRDNSKNTLNLQMNSLRAEDTAVYYCVRGRLATAIKLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 555 - protein, 219 aa, Artificial Sequence
  Synthetic Peptide
DILMTQTPLSLSVTPGQPASISCKSSQSLLYSDGKTYLFWYLQRPGQPPQLLIYEVSNRFSGVPDRFSGSGSGTDFTLKISRVEAEDVGIYYCMQTLKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 556 - protein, 355 aa, Artificial Sequence
  Synthetic Peptide
MDYRLDPSMTTMTDYYYPDSLSSPCDGELIQRNDKLLLAVFYCLLFVFSLLGNSLVILVLVVCKKLRNITDIYLLNLALSDLLFVFSFPFQTYYQLDQWVFGTVMCKVVSGFYYIGFYSSMFFITLMSVDRYLAVVHAVYAIKVRTIRMGTTLSLVVWLTAIMATIPLLVFYQVASEDGVLQCYSFYNQQTLKWKIFTNFEMNILGLLIPFTIFMFCYIKILHQLKRCQNHNKTKAIRLVLIVVIASLLFWVPFNVVLFLTSLHSMHILDGCSISQQLNYATHVTEIISFTHCCVNPVIYAFVGEKFKKHLSEIFQKSCSHIFIYLGRQMPRESCEKSSSCQQHSFRSSSIDYIL

SEQ ID NO: 557 - protein, 22 aa, Artificial Sequence
  Synthetic Peptide
MDMRVPAQLLGLLLLWLRGARC

SEQ ID NO: 558 - DNA, 66 bp, Artificial Sequence
  Synthetic Peptide
atggacatgagagtgcctgcacagctgctgggcctgctgctgctgtggctgagaggcgccagatgc

SEQ ID NO: 559 - protein, 19 aa, Artificial Sequence
  Synthetic Peptide
MAWALLLLTLLTQGTGSWA

SEQ ID NO: 560 - DNA, 57 bp, Artificial Sequence
  Synthetic Peptide
atggcctgggctctgctgctcctcaccctcctcactcagggcacagggtcctgggcc

SEQ ID NO: 561 - protein, 5 aa, Artificial Sequence
  Synthetic Peptide
NARMG

SEQ ID NO: 562 - protein, 19 aa, Artificial Sequence
  Synthetic Peptide
RIKSKTEGGTRDYAAPVKG

SEQ ID NO: 563 - protein, 4 aa, Artificial Sequence
  Synthetic Peptide
YSGV

SEQ ID NO: 564 - protein, 17 aa, Artificial Sequence
  Synthetic Peptide
KSSQSVLYSSNNKNYLA

SEQ ID NO: 565 - protein, 7 aa, Artificial Sequence
  Synthetic Peptide
WASTRES

SEQ ID NO: 566 - protein, 9 aa, Artificial Sequence
  Synthetic Peptide
QQYYSIPIT

SEQ ID NO: 567 - protein, 5 aa, Artificial Sequence
  Synthetic Peptide
NYGMH

SEQ ID NO: 568 - protein, 17 aa, Artificial Sequence
  Synthetic Peptide
VISYDGSNKFYADSVKG

SEQ ID NO: 569 - protein, 9 aa, Artificial Sequence
  Synthetic Peptide
AGGIGRFDY

SEQ ID NO: 570 - protein, 16 aa, Artificial Sequence
  Synthetic Peptide
KYSQSLLHSDGKTYLF

SEQ ID NO: 571 - protein, 7 aa, Artificial Sequence
  Synthetic Peptide
EVSNRFS

SEQ ID NO: 572 - protein, 9 aa, Artificial Sequence
  Synthetic Peptide
MQTLKLPLT

SEQ ID NO: 573 - protein, 444 aa, Artificial Sequence
  Synthetic Peptide
EVQLVESGGGLVKPGGSLRLSCAASGFTFSNARMGWVRQAPGKGLEWVGRIKSKTEGGTRDYAAPVKGRFTISRDDSKNTLYLQMNSLKTEDTAVYYCTSYSGVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 574 - protein, 444 aa, Artificial Sequence; identical to SEQ ID NO: 573
  Synthetic Peptide

SEQ ID NO: 575 - protein, 447 aa, Artificial Sequence
  Synthetic Peptide
QVQLVESGGGVVQPGRSLRLSCAASGFTFSNYGMHWVRQAPGKGLEWVAVISYDGSNKFYIRSVKGRFTISRDNSKNTLYLQMNSLRAEDTAVYYCARAGGIGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 576 - protein, 447 aa, Artificial Sequence
  Synthetic Peptide
QVQLVESGGGVVQPGRSLRLSCAASGFTFSNYGMHWVRQAPGKGLEWVAVISYDGSNKFYLKSVKGRFTISRDNSKNTLYLQMNSLRAEDTAVYYCARAGGIGRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 577 - protein, 451 aa, Artificial Sequence
  Synthetic Peptide
EVQLVESGGGLVKPGGSLRLSCAASGFIFSNAWMSWVRQAPGKGLEWVARIKRRTDGGTTDYAAPVKDRFTISRDDSKNTLFLQMNSLKTEDTAVYYCTTVTMVRGVIADYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 578 - protein, 451 aa, Artificial Sequence
  Synthetic Peptide
EVQLVESGGGLVKPGGSLRLSCAASGFIFSNAWMSWVRQAPGKGLEWVGRIKRKTDGGTTDYAAPVKGRFTISRDDSKNTLYLLMNSLKIEDTAVYYCTVVTLVRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 579 - protein, 451 aa, Artificial Sequence
  Synthetic Peptide
EVQLVESGGGLVKPGGSLRLSCAASGFIFSNAWLQWVRQAPGKGLEWVGRIKRKTDQLTTDYAAPVKGRFTISRDDSKNTLYLLMNSLKIEDTAVYYCTVVTRSRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 580 - protein, 451 aa, Artificial Sequence
  Synthetic Peptide
EVQLVESGGGLVKPGGSLRLSCAASGFIFSNAWLQWVRQAPGKGLEWVGRIKRKTDASTTDYAAPVKGRFTISRDDSKNTLYLLMNSLKIEDTAVYYCTVVTRSRGIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 581 - protein, 449 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 582 - protein, 449 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYFDWTLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 583 - protein, 449 aa, Artificial Sequence
  Synthetic Peptide
QVQLVESGGGVVQPGRSLRLSCAASGFTFSSYPMHWVRQAPGKGLEWVAVISYDGSNKYYADSVKGRFTISRDNSKNTLYLQMNSLRAEDTAVYYCARGRYFDWTLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 584 - protein, 449 aa, Artificial Sequence
  Synthetic Peptide
QVQLVESGGGVVQPGRSLRLSCAASGFTFSSYGMHWVRQAPGKGLEWVAVISYDGSNKYYSRSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 585 - protein, 449 aa, Artificial Sequence
  Synthetic Peptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 586 - protein, 449 aa, Artificial Sequence
  Synthetic Peptide
QVQLVESGGGVVQPGRSLRLSCAASGFTFSSYPVHWVRQAPGKGLEWVAVISYDGSNKYYADSVKGRFTISRDNSKNTLYLQMNSLRAEDTAVYYCARGRYFDWFLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 587 - protein, 449 aa, Artificial Sequence; identical to SEQ ID NO: 582
  Synthetic Peptide

SEQ ID NO: 588 - protein, 449 aa, Artificial Sequence; identical to SEQ ID NO: 584
  Synthetic Peptide

SEQ ID NO: 589 - protein, 449 aa, Artificial Sequence; identical to SEQ ID NO: 583
  Synthetic Peptide

SEQ ID NO: 590 - protein, 449 aa, Artificial Sequence; identical to SEQ ID NO: 585
  Synthetic Peptide

SEQ ID NO: 591 - protein, 449 aa, Artificial Sequence
  Synthetic Peptide
QVQLVESGGGVVQPGRSLRLSCEASGFTFSSYVMHWVRQAPGKGLEWVSVISYDGSSQYYTDSVKGRFTISRDNSKNTLNLQMNSLRAEDTAVYYCVRGRLATAILFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 592 - protein, 449 aa, Artificial Sequence
  Synthetic Peptide
QVQLVESGGGVVQPGRSLRLSCEASGFTFSSYVMHWVRQAPGKGLEWVSVISYDGSRQYYTDSVKGRFTISRDNSKNTLNLQMNSLRAEDTAVYYCVRGRLATSPLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 593 - protein, 449 aa, Artificial Sequence
  Synthetic Peptide
QVQLVESGGGVVQPGRSLRLSCEASGFTFSSYVMHWVRQAPGKGLEWVSVISYDGSRAYYTDSVKGRFTISRDNSKNTLNLQMNSLRAEDTAVYYCVRGRLATAIKLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 594 - DNA, 1338 bp, Artificial Sequence
  Synthetic Peptide
gaggtgcagctggtggagtctgggggaggcttggtaaagcctggggggtccctgagactctcctgtgcagcctctggatttactttcagtaacgcccggatgggctgggtccgccaggctccagggaaggggctggagtgggttggccgtattaaaagcaaaactgaaggtgggacaagagactacgctgcacccgtgaaaggcagattcaccatctcaagagatgattcaaaaaacacgctgtatctgcaaatgaacagcctgaaaaccgaggacacagccgtgtattattgtacctcgtatagtggggtctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 595 - DNA, 663 bp, Artificial Sequence
  Synthetic Peptide
gacatcgtgatgacccagtctccagactccctggctgtgtctctgggcgagagggccaccatcaactgcaagtccagccagagtgttttatacagttccaacaataagaactacttagcttggtaccatcagaaaccaggacagtctcctaagctgctcatttcctgggcatctacccgggaatccggggtccctgaccgattcagtggcagcgggtctgggacagatttcactctcaccatcaacagcctgcaggctgaagatgtggcagtttattactgtcaacaatattatagtattccgatcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 596 - DNA, 1338 bp, Artificial Sequence; identical to SEQ ID NO: 594
  Synthetic Peptide

SEQ ID NO: 597 - DNA, 663 bp, Artificial Sequence
  Synthetic Peptide
gacatcgtgatgacccagtctccagactccctggctgtgtctctgggcgagagggccaccatcaactgcaagtccagccagagtgttttatacagttccaacaataagaactacttagcttggtaccagcagaaaccaggacagccccctaagctgctcatttcctgggcatctacccgggaatccggggtccctgaccgattcagtggcagcgggtctgggacagatttcactctcaccatcaacagcctgcaggctgaagatgtggcagtttattactgtcaacaatattatagtattccgatcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 598 - DNA, 1347 bp, Artificial Sequence
  Synthetic Peptide
caggtgcagttggtggagtctgggggaggcgtggtccagcctgggaggtccctgagactctcctgtgcagcctctggattcaccttcagtaactatggcatgcactgggtccgccaggctccaggcaaggggctggagtgggtggcagtcatatcatatgatggaagtaataaattctatatcagatccgtgaagggccgattcaccatctccagagacaattccaagaacactctgtatcttcaaatgaacagcctgagagccgaggacacggctgtatattattgtgcgagagccgggggtatagggcgttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 599 - protein, 660 aa, Artificial Sequence
  Synthetic Peptide
GATATCGTAATGACCCAGACTCCACTCTCTCTGTCCGTCACCCCTGGACAGCCGGCCTCCATCTCCTGCAAGGCCGCCCAGAGCCTCCTGCACAGTGATGGAAAGACCTATTTGTTTTGGTACCTGCAGAAGCCAGGCCAGAGCCCACAGCTCCTGATCTATGAAGTTTCCAACCGGTTCTCTGGAGTGCCAGATAGGTTCAGTGGCAGCGGGTCAGGGACAGATTTCACACTGAAGATCAGCCGGGTGGAGGCTGAGGATGTTGGGGTGTATTACTGCATGCAAACTTTAAAGCTTCCGCTCACTTTCGGCGGAGGGACCAAGGTGGAGATCAAGCGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAG

SEQ ID NO: 600 - DNA, 1347 bp, Artificial Sequence
  Synthetic Peptide
caggtgcagttggtggagtctgggggaggcgtggtccagcctgggaggtccctgagactctcctgtgcagcctctggattcaccttcagtaactatggcatgcactgggtccgccaggctccaggcaaggggctggagtgggtggcagtcatatcatatgatggaagtaataaattctatctgaagtccgtgaagggccgattcaccatctccagagacaattccaagaacactctgtatcttcaaatgaacagcctgagagccgaggacacggctgtatattattgtgcgagagccgggggtatagggcgttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 601 - DNA, 660 bp, Artificial Sequence
  Synthetic Peptide
gatatcgtaatgacccagactccactctctctgtccgtcacccctggacagccggcctccatctcctgcaaggccagtcagagcctcctgcacagtgatggaaagacctatttgttttggtacctgcagaagccaggccagagcccacagctcctgatctatgaagtttccaaccggttctctggagtgccagataggttcagtggcagcgggtcagggacagatttcacactgaagatcagccgggtggaggctgaggatgttggggtgtattactgcatgcaaactttaaagcttccgctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 602 - protein, 1359 aa, Artificial Sequence
  Synthetic Peptide
GAGGTGCAGCTGGTGGAGTCTGGGGGAGGCTTGGTAAAGCCTGGGGGGTCCCTTAGACTCTCCTGTGCAGCCTCTGGATTCATTTTTAGTAATGCCTGGATGAGCTGGGTCCGCCAGGCTCCAGGGAAGGGGCTGGAGTGGGTTGCCCGTATTAAAAGGAGAACTGATGGTGGGACAACTGACTACGCTGCACCCGTGAAAGACAGATTCACCATCTCAAGAGATGATTCAAAAAACACGCTGTTTCTGCAAATGAACAGCCTGAAAACCGAGGACACAGCCGTGTATTACTGTACCACAGTTACTATGGTTCGGGGAGTTATTGCTGATTACTGGGGCCAGGGAACCCTGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG

SEQ ID NO: 603 - DNA, 645 bp, Artificial Sequence
  Synthetic Peptide
gaaattgtgttgacgcagtctccaggcaccctgtctttgtctccaggggaaagagccaccctctcctgcagggccagtcagagtgttagcagcggctccttagcctggtaccagcagaaacttggccaggctcccaggctcctcatctatggtgcatccagcagggccactggcatcccagacaggttcagtggcagtgggtctgggacagacttcactctcaccatcagcagcctggagcctgaagattttgcagtgtattactgtcaacagtatggtagctcacggacgttcggccaagggaccaaggtggagctcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 604 - DNA, 1359 bp, Artificial Sequence
  Synthetic Peptide
gaggtgcagctggtggagtctgggggaggcttggtaaagcctggggggtcccttagactctcctgtgcagcctctggattcattttcagtaacgcctggatgagctgggtccgccaggctccagggaaggggctggagtgggttggccgtataaaaaggaaaactgatggtggtacaacagactacgctgcacccgtgaaaggcagattcaccatctcaagagatgattcaaaaaacacgttgtatctgctaatgaacagcctgaaaatcgaggacacagccgtgtattattgtaccgtcgtaactttggttcggggaattatctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 605 - DNA, 645 bp, Artificial Sequence
  Synthetic Peptide
gaaattgtgttgacgcagtctccgggcaccctgtctttgtctccaggggaaagcgccaccctctcctgtagggtcagtcagagtgtcagcagcagccagttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaactcacggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 606 - DNA, 1359 bp, Artificial Sequence
  Synthetic Peptide
gaggtgcagctggtggagtctgggggaggcttggtaaagcctggggggtcccttagactctcctgtgcagcctctggattcattttcagtaacgcctggctgcagtgggtccgccaggctccagggaaggggctggagtgggttggccgtatcaaaaggaaaactgatcagctgacaacagactacgctgcacccgtgaaaggcagattcaccatctcaagagatgattcaaaaaacacgttgtatctgctaatgaacagcctgaaaatcgaggacacagccgtgtattattgtaccgtcgtaactagaagccggggaattatctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 607 - DNA, 645 bp, Artificial Sequence
  Synthetic Peptide
gaaattgtgttgacgcagtctccgggcaccctgtctttgtctccaggggaaagcgccaccctctcctgtagggtcagtcagagtgtcagcagcagccagttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaacccccggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 608 - protein, 1359 aa, Artificial Sequence
  Synthetic Peptide
GAGGTGCAGCTGGTGGAGTCTGGGGGAGGCTTGGTAAAGCCTGGGGGGTCCCTTAGACTCTCCTGTGCAGCCTCTGGATTCATTTTCAGTAACGCCTGGCTGCAGTGGGTCCGCCAGGCTCCAGGGAAGGGGCTGGAGTGGGTTGGCCGTATCAAAAGGAAAACTGATGCCAGCACAACAGACTACGCTGCACCCGTGAAAGGCAGATTCACCATCTCAAGAGATGATTCAAAAAACACGTTGTATCTGCTAATGAACAGCCTGAAAATCGAGGACACAGCCGTGTATTATTGTACCGTCGTAACTAGAAGCCGGGGAATTATCTTTGACTACTGGGGCCAGGGAACCCTGGTCACCGTGTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG

SEQ ID NO: 609 - DNA, 1359 bp, Artificial Sequence
  Synthetic Peptide
gaggtgcagctggtggagtctgggggaggcttggtaaagcctggggggtcccttagactctcctgtgcagcctctggattcattttcagtaacgcctggctgcagtgggtccgccaggctccagggaaggggctggagtgggttggccgtatcaaaaggaaaactgatgccagcacaacagactacgctgcacccgtgaaaggcagattcaccatctcaagagatgattcaaaaaacacgttgtatctgctaatgaacagcctgaaaatcgaggacacagccgtgtattattgtaccgtcgtaactagaagccggggaattatctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 610 - protein, 1353 aa, Artificial Sequence
  Synthetic Peptide
CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCAGTTATATCATATGATGGAAGTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGGGGGCGATATTTTGACTGGTTCCTCTTTGACTACTGGGGCCAGGGAACCCTGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG

SEQ ID NO: 611 - protein, 660 aa, Artificial Sequence
  Synthetic Peptide
GATACTGTGATGACCCAGACTCCACTCTCTCTGTCCGTCACCCCTGGACAGCCGGCCTCCATCTCCTGCAAGTCTAGTCAGAGCCTCCTACATAGTGATGGAAAGACCTATTTGTTTTGGTACCTGCAGAAGCCAGGCCAGCCTCCACAGCTCCTGATCAGTGAAGTTTCCAACCGGTTCTCTGGAGTGCCAGATAGGTTCAGTGGCAGCGGGTCAGGGACAGATTTCACACTGAAAATCAGCCGTGTGGAGGCTGAGGATGTTGGGTTTTATTACTGCATGCAAAGTTTACGGCTTCCGCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAG

SEQ ID NO: 612 - protein, 1353 aa, Artificial Sequence
  Synthetic Peptide
CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCAGTTATCTCATATGATGGAAGTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGGGGGCGATATTTTGACTGGACCCTCTTTGACTACTGGGGCCAGGGAACCCTGGTCACCGTGTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG

SEQ ID NO: 613 - DNA, 660 bp, Artificial Sequence
  Synthetic Peptide
gatactgtgatgacccagactccactctctctgtccgtcacccctggacagccggcctccatctcctgcaagtctagtcagagcctcctacatagagatggaaagacctatttgttttggtacctgcagaagccaggccagcctccacagctcctgatctacgaagtttccaaccggttctctggagtgccagataggttcagtggcagcgggtcagggacagatttcacactgaaaatcagccgtgtggaggctgaggatgttggggtgtattactgcatgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 614 - DNA, 1353 bp, Artificial Sequence
  Synthetic Peptide
caggtgcagctggtggagtctgggggaggcgtggtccagcctgggaggtccctgagactctcctgtgcagcctctggattcaccttcagtagctatcccatgcactgggtccgccaggctccaggcaaggggctggagtgggtggcagttatctcatatgatggaagtaataaatactatgcagactccgtgaagggccgattcaccatctccagagacaattccaagaacacgctgtatctgcaaatgaacagcctgagagctgaggacacggctgtgtattactgtgcgagggggcgatattttgactggaccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 615 - DNA, 660 bp, Artificial Sequence
  Synthetic Peptide
gatactgtgatgacccagactccactctctctgtccgtcacccctggacagccggcctccatctcctgcaagtctagtcagagcctcctacatagtgatggaaagacctatttgttttggtacctgcagaagccaggccagcctccacagctcctgatctacctgagatccaaccggttctctggagtgccagataggttcagtggcagcgggtcagggacagatttcacactgaaaatcagccgtgtggaggctgaggatgttggggtgtattactgcatgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 616 - DNA, 1353 bp, Artificial Sequence
  Synthetic Peptide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatctcatatgatggaagtaataaatactatagcagatccgtgaagggccgattcaccatctccagagacaattccaagaacacgctgtatctgcaaatgaacagcctgagagctgaggacacggctgtgtattactgtgcgagggggcgatattttgactggttcctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 617 - DNA, 660 bp, Artificial Sequence
  Synthetic Peptide
gatactgtgatgacccagactccactctctctgtccgtcacccctggacagccggcctccatctcctgcaagtctagtcagagcctcctacatagtgatggaaagacctatttgttttggtacctgcagaagccaggccagcctccacagctcctgatctacctgagctccaaccggttctctggagtgccagataggttcagtggcagcgggtcagggacagatttcacactgaaaatcagccgtgtggaggctgaggatgttggggtgtattactgcatgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 618 - protein, 1353 aa, Artificial Sequence
  Synthetic Peptide
CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTATGCCATGCACTGGGTCCGCCAGGCTCCAGGCAAGGGGCTGGAGTGGGTGGCAGTTATCTCATATGATGGAAGTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGGGGGCGATATTTTGACTGGTTCCTCTTTGACTACTGGGGCCAGGGAACCCTGGTCACCGTGTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG

SEQ ID NO: 619 - DNA, 660 bp, Artificial Sequence
  Synthetic Peptide
gatactgtgatgacccagactccactctctctgtccgtcacccctggacagccggcctccatctcctgcaagtctagtcagagcctcctacatagtgatggaaagacctatttgttttggtacctgcagaagccaggccagcctccacagctcctgatctacctgacctccaaccggttctctggagtgccagataggttcagtggcagcgggtcagggacagatttcacactgaaaatcagccgtgtggaggctgaggatgttggggtgtattactgcatgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 620 - DNA, 1353 bp, Artificial Sequence
  Synthetic Peptide
caggtgcagctggtggagtctgggggaggcgtggtccagcctgggaggtccctgagactctcctgtgcagcctctggattcaccttcagtagctatcccgtgcactgggtccgccaggctccaggcaaggggctggagtgggtggcagttatctcatatgatggaagtaataaatactatgcagactccgtgaagggccgattcaccatctccagagacaattccaagaacacgctgtatctgcaaatgaacagcctgagagctgaggacacggctgtgtattactgtgcgagggggcgatattttgactggttcctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 621 - DNA, 660 bp, Artificial Sequence; identical to SEQ ID NO: 619
  Synthetic Peptide

SEQ ID NO: 622 - DNA, 1353 bp, Artificial Sequence
  Synthetic Peptide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatctcatatgatggaagtaataaatactatgcagactccgtgaagggccgattcaccatctccagagacaattccaagaacacgctgtatctgcaaatgaacagcctgagagctgaggacacggctgtgtattactgtgcgagggggcgatattttgactggaccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 623 - DNA, 660 bp, Artificial Sequence
  Synthetic Peptide
gatactgtgatgacccagactccactctctctgtccgtcacccctggacagccggcctccatctcctgcaagtctagtcagagcctcctacatagagatgccagaacctatttgttttggtacctgcagaagccaggccagcctccacagctcctgatctacgaagtttccaaccggttctctggagtgccagataggttcagtggcagcgggtcagggacagatttcacactgaaaatcagccgtgtggaggctgaggatgttggggtgtattactgcctgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 624 - DNA, 1353 bp, Artificial Sequence; identical to SEQ ID NO: 616
  Synthetic Peptide

SEQ ID NO: 625 - DNA, 660 bp, Artificial Sequence
  Synthetic Peptide
gatactgtgatgacccagactccactctctctgtccgtcacccctggacagccggcctccatctcctgcaagtctagtcagagcctcctacatagtgatgccagaacctatttgttttggtacctgcagaagccaggccagcctccacagctcctgatctacctgagctccaaccggttctctggagtgccagataggttcagtggcagcgggtcagggacagatttcacactgaaaatcagccgtgtggaggctgaggatgttggggtgtattactgcctgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 626 - DNA, 1353 bp, Artificial Sequence; identical to SEQ ID NO: 614
  Synthetic Peptide

SEQ ID NO: 627 - DNA, 660 bp, Artificial Sequence
  Synthetic Peptide
gatactgtgatgacccagactccactctctctgtccgtcacccctggacagccggcctccatctcctgcaagtctagtcagagcctcctacatagtgatgccagaacctatttgttttggtacctgcagaagccaggccagcctccacagctcctgatctacctgagatccaaccggttctctggagtgccagataggttcagtggcagcgggtcagggacagatttcacactgaaaatcagccgtgtggaggctgaggatgttggggtgtattactgcctgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 628 - DNA, 1353 bp, Artificial Sequence
  Synthetic Peptide
caggtgcagctggtggagtctgggggaggcgtggtccagcctgggaggtccctgagactctcctgtgcagcctctggattcaccttcagtagctatgccatgcactgggtccgccaggctccaggcaaggggctggagtgggtggcagttatctcatatgatggaagtaataaatactatgcagactccgtgaagggccgattcaccatctccagagacaattccaagaacacgctgtatctgcaaatgaacagcctgagagctgaggacacggctgtgtattactgtgcgagggggcgatattttgactggttcctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 629 - DNA, 660 bp, Artificial Sequence
  Synthetic Peptide
gatactgtgatgacccagactccactctctctgtccgtcacccctggacagccggcctccatctcctgcaagtctagtcagagcctcctacatagtgatgccagaacctatttgttttggtacctgcagaagccaggccagcctccacagctcctgatctacctgacctccaaccggttctctggagtgccagataggttcagtggcagcgggtcagggacagatttcacactgaaaatcagccgtgtggaggctgaggatgttggggtgtattactgcctgcaaagtttacggcttccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 630 - DNA, 1353 bp, Artificial Sequence
  Synthetic Peptide
caggtgcagctggtggagtctgggggaggcgtggtccagcctgggaggtccctgagactctcctgtgaagcctctggattcaccttcagtagctatgtcatgcactgggtccgccaggctccaggcaaggggctggagtgggtgtcagttatatcatatgatggaagtagtcaatactatacagactccgtgaagggccgattcaccatctccagagacaattccaagaatacgctgaatctgcaaatgaacagcctgagagctgaggacacggctgtgtattactgtgtgagaggccgtttggccactgctatcctctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 631 - DNA, 660 bp, Artificial Sequence
  Synthetic Peptide
gatattttgatgacccagactccactctctctgtccgtcacccctggacagccggcctccatctcctgcaagtctagccagagcctcctatatagtgatggaaagacctatttattttggtacctgcagaggccaggccaacctccacagctcctgatctatgaagtttccaaccggttctctggagtgccagataggttcagtggcagcgggtcagggacagatttcacactgaaaatcagccgggtggaggctgaggatgttgggatttattactgcatgcaaagtataaaacttcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 632 - DNA, 1353 bp, Artificial Sequence
  Synthetic Peptide
caggtgcagctggtggagtctgggggaggcgtggtccagcctgggaggtccctgagactctcctgtgaagcctctggattcaccttcagtagctatgtcatgcactgggtccgccaggctccaggcaaggggctggagtgggtgtcagttatctcatatgatggaagtagacaatactatacagactccgtgaagggccgattcaccatctccagagacaattccaagaatacgctgaatctgcaaatgaacagcctgagagctgaggacacggctgtgtattactgtgtgagaggccgtttggccactagccccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 633 - DNA, 660 bp, Artificial Sequence
  Synthetic Peptide
gatattttgatgacccagactccactctctctgtccgtcacccctggacagccggcctccatctcctgcaagtctagccagagcctcctatatagtgatggaaagacctatttattttggtacctgcagaggccaggccaacctccacagctcctgatctatgaagtttccaaccggctgtctggagtgccagataggttcagtggcagcgggtcagggacagatttcacactgaaaatcagccgggtggaggctgaggatgttgggatttattactgcatgcaaagtatcaaacttcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 634 - DNA, 1353 bp, Artificial Sequence
  Synthetic Peptide
caggtgcagctggtggagtctgggggaggcgtggtccagcctgggaggtccctgagactctcctgtgaagcctctggattcaccttcagtagctatgtcatgcactgggtccgccaggctccaggcaaggggctggagtgggtgtcagttatctcatatgatggaagtagagcctactatacagactccgtgaagggccgattcaccatctccagagacaattccaagaatacgctgaatctgcaaatgaacagcctgagagctgaggacacggctgtgtattactgtgtgagaggccgtttggccactgctatcaagctggactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 635 - DNA, 660 bp, Artificial Sequence
  Synthetic Peptide
gatattttgatgacccagactccactctctctgtccgtcacccctggacagccggcctccatctcctgcaagtctagccagagcctcctatatagtgatggaaagacctatttattttggtacctgcagaggccaggccaacctccacagctcctgatctatgaagtttccaaccggttctctggagtgccagataggttcagtggcagcgggtcagggacagatttcacactgaaaatcagccgggtggaggctgaggatgttgggatttattactgcatgcaaaccctgaaacttcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 636 - protein, 449 aa, Artificial Sequence
  Synthetic Peptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 637 - protein, 16 aa, Artificial Sequence
  Synthetic Peptide
KYSQSLLHSDGKTYLF

SEQ ID NO: 638 - protein, 7 aa, Artificial Sequence
  Synthetic Peptide
EVSNRFS

SEQ ID NO: 639 - protein, 9 aa, Artificial Sequence
  Synthetic Peptide
MQTLKLPLT

SEQ ID NO: 640 - protein, 5 aa, Artificial Sequence
  Synthetic Peptide
NYGMH

SEQ ID NO: 641 - protein, 17 aa, Artificial Sequence
  Synthetic Peptide
VISYDGSRNFYADSVKG

SEQ ID NO: 642 - protein, 9 aa, Artificial Sequence
  Synthetic Peptide
AGGNGRFDY

SEQ ID NO: 643 - protein, 113 aa, Artificial Sequence
  Synthetic Peptide
DIVMTQTPLSLSVTPGQPASISCKYSQSLLHSDGKTYLFWYLQKPGQSPQLLIYEVSNRFSGVPDRFSGSGSGTDFTLKISRVEAEDVGVYYCMQTLKLPLTFGGGTKVEIKR

SEQ ID NO: 644 - protein, 118 aa, Artificial Sequence
  Synthetic Peptide
QVQLVESGGGVVQPGRSLRLSCAASGFTFSNYGMHWVRQAPGKGLEWVAVISYDGSRNFYADSVKGRFTISRDNSKNTLYLQMNSLRAEDTAVYYCARAGGNGRFDYWGQGTLVTVSS

SEQ ID NO: 645 - protein, 219 aa, Artificial Sequence
  Synthetic Peptide
DIVMTQTPLSLSVTPGQPASISCKYSQSLLHSDGKTYLFWYLQKPGQSPQLLIYEVSNRFSGVPDRFSGSGSGTDFTLKISRVEAEDVGVYYCMQTLKLPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 646 - protein, 448 aa, Artificial Sequence
  Synthetic Peptide
QVQLVESGGGVVQPGRSLRLSCAASGFTFSNYGMHWVRQAPGKGLEWVAVISYDGSRNFYADSVKGRFTISRDNSKNTLYLQMNSLRAEDTAVYYCARAGGNGRFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 647 - protein, 5 aa, Artificial Sequence
  Synthetic Peptide
NNGMH

SEQ ID NO: 648 - protein, 17 aa, Artificial Sequence
  Synthetic Peptide
VISNDGSNKYYADSVKG

SEQ ID NO: 649 - protein, 19 aa, Artificial Sequence
  Synthetic Peptide
VYYGSGIYYKNRNYYGMDV

SEQ ID NO: 650 - protein, 11 aa, Artificial Sequence
  Synthetic Peptide
GGNNIGSQNVH

SEQ ID NO: 651 - protein, 7 aa, Artificial Sequence
  Synthetic Peptide
RDSNRPS

SEQ ID NO: 652 - protein, 9 aa, Artificial Sequence
  Synthetic Peptide
QVWDSSTVV

SEQ ID NO: 653 - protein, 5 aa, Artificial Sequence
  Synthetic Peptide
NYGMH

SEQ ID NO: 654 - protein, 17 aa, Artificial Sequence
  Synthetic Peptide
VISYDGSNKYYADSVKG

SEQ ID NO: 655 - protein, 19 aa, Artificial Sequence
  Synthetic Peptide
VYYGSGIYYKKRYYYGMDV

SEQ ID NO: 656 - protein, 11 aa, Artificial Sequence
  Synthetic Peptide
GGHNIGSKGVH

SEQ ID NO: 657 - protein, 7 aa, Artificial Sequence
  Synthetic Peptide
RNSNRPS

SEQ ID NO: 658 - protein, 9 aa, Artificial Sequence
  Synthetic Peptide
QVWDSSTVV

SEQ ID NO: 659 - protein, 5 aa, Artificial Sequence
  Synthetic Peptide
NYGMH

SEQ ID NO: 660 - protein, 17 aa, Artificial Sequence
  Synthetic Peptide
VISYDGSNKYYADSVKG

SEQ ID NO: 661 - protein, 19 aa, Artificial Sequence
  Synthetic Peptide
VYYGSGSYYKKRYYYGMDV

SEQ ID NO: 662 - protein, 11 aa, Artificial Sequence
  Synthetic Peptide
GGNNIGSQNVH

SEQ ID NO: 663 - protein, 7 aa, Artificial Sequence
  Synthetic Peptide
RDSNRPS

SEQ ID NO: 664 - protein, 9 aa, Artificial Sequence
  Synthetic Peptide
QVWDSSTVV

SEQ ID NO: 665 - protein, 5 aa, Artificial Sequence
  Synthetic Peptide
SSGMH

SEQ ID NO: 666 - protein, 17 aa, Artificial Sequence
  Synthetic Peptide
VISYDGTNKYYADSVKG

SEQ ID NO: 667 - protein, 19 aa, Artificial Sequence
  Synthetic Peptide
VYYGSGIYYKNRYYYGMDV

SEQ ID NO: 668 - protein, 11 aa, Artificial Sequence
  Synthetic Peptide
GGHNIGSKGVH

SEQ ID NO: 669 - protein, 7 aa, Artificial Sequence
  Synthetic Peptide
RNSNRPS

SEQ ID NO: 670 - protein, 9 aa, Artificial Sequence
  Synthetic Peptide
QVWDSSTVV

SEQ ID NO: 671 - protein, 5 aa, Artificial Sequence
  Synthetic Peptide
NYGMH

SEQ ID NO: 672 - protein, 17 aa, Artificial Sequence
  Synthetic Peptide
VISNDGSNKYYADSVKG

SEQ ID NO: 673 - protein, 19 aa, Artificial Sequence
  Synthetic Peptide
VYYGSGIYYKKRYYYGMDV

SEQ ID NO: 674 - protein, 11 aa, Artificial Sequence
  Synthetic Peptide
GGHNIGSQNVH

SEQ ID NO: 675 - protein, 7 aa, Artificial Sequence
  Synthetic Peptide
RDSNRPS

SEQ ID NO: 676 - protein, 9 aa, Artificial Sequence
  Synthetic Peptide
QVWDSSTVV

SEQ ID NO: 677 - protein, 5 aa, Artificial Sequence
  Synthetic Peptide
NYGMH

SEQ ID NO: 678 - protein, 17 aa, Artificial Sequence
  Synthetic Peptide
VISYDGSNKYYADSVKG

SEQ ID NO: 679 - protein, 19 aa, Artificial Sequence
  Synthetic Peptide
VYYGSGIYYKKRYYYGMDV

SEQ ID NO: 680 - protein, 11 aa, Artificial Sequence
  Synthetic Peptide
GGNNIGSKNVH

SEQ ID NO: 681 - protein, 7 aa, Artificial Sequence
  Synthetic Peptide
RNSNRPS

SEQ ID NO: 682 - protein, 9 aa, Artificial Sequence
  Synthetic Peptide
QVWDSSTVV

SEQ ID NO: 683 - protein, 5 aa, Artificial Sequence
  Synthetic Peptide
SYGMH

SEQ ID NO: 684 - protein, 17 aa, Artificial Sequence
  Synthetic Peptide
VISYDGSNKYYADSVKG

SEQ ID NO: 685 - protein, 19 aa, Artificial Sequence
  Synthetic Peptide
VYYGSGSYYKNRYYYGMDV

SEQ ID NO: 686 - protein, 11 aa, Artificial Sequence
  Synthetic Peptide
GGNNIGSKNVH

SEQ ID NO: 687 - protein, 7 aa, Artificial Sequence
  Synthetic Peptide
RDINRPS

SEQ ID NO: 688 - protein, 8 aa, Artificial Sequence
  Synthetic Peptide
QVWDSSVV

SEQ ID NO: 689 - protein, 5 aa, Artificial Sequence
  Synthetic Peptide
NYGMH

SEQ ID NO: 690 - protein, 17 aa, Artificial Sequence
  Synthetic Peptide
VISYDGSNKYYADSVKG

SEQ ID NO: 691 - protein, 19 aa, Artificial Sequence
  Synthetic Peptide
VYYGSGIYYKKRYYYGMDV

SEQ ID NO: 692 - protein, 11 aa, Artificial Sequence
  Synthetic Peptide
EGNNIGSKNVH

SEQ ID NO: 693 - protein, 7 aa, Artificial Sequence
  Synthetic Peptide
RNSNRPS

SEQ ID NO: 694 - protein, 9 aa, Artificial Sequence
  Synthetic Peptide
QAWDSSTVV

SEQ ID NO: 695 - protein, 5 aa, Artificial Sequence
  Synthetic Peptide
NNGMH

SEQ ID NO: 696 - protein, 17 aa, Artificial Sequence
  Synthetic Peptide
VISYDGSNKYYTDSVKG

SEQ ID NO: 697 - protein, 19 aa, Artificial Sequence
  Synthetic Peptide
VYYGSGIYYKKRYYYGMDV

SEQ ID NO: 698 - protein, 11 aa, Artificial Sequence
  Synthetic Peptide
GGNNIGSKNVH

SEQ ID NO: 699 - protein, 7 aa, Artificial Sequence
  Synthetic Peptide
RDSNRPS

SEQ ID NO: 700 - protein, 11 aa, Artificial Sequence
  Synthetic Peptide
QVWDSSSDHVV

SEQ ID NO: 701 - protein, 5 aa, Artificial Sequence
  Synthetic Peptide
NYGMH

SEQ ID NO: 702 - protein, 17 aa, Artificial Sequence
  Synthetic Peptide
VISYDGSNKYYADSVKG

SEQ ID NO: 703 - protein, 19 aa, Artificial Sequence
  Synthetic Peptide
VYYGSGIYYKKRYYYGMDV

SEQ ID NO: 704 - protein, 11 aa, Artificial Sequence
  Synthetic Peptide
GGNNIGSKNVH

SEQ ID NO: 705 - protein, 7 aa, Artificial Sequence
  Synthetic Peptide
RNSNRPS

SEQ ID NO: 706 - protein, 9 aa, Artificial Sequence
  Synthetic Peptide
QAWDSSNVV

SEQ ID NO: 707 - protein, 5 aa, Artificial Sequence
  Synthetic Peptide
RNGMH

SEQ ID NO: 708 - protein, 17 aa, Artificial Sequence
  Synthetic Peptide
VISNDGSNKYYADSVKG

SEQ ID NO: 709 - protein, 19 aa, Artificial Sequence
  Synthetic Peptide
VYYGSGIYYKNNYYYGMDV

SEQ ID NO: 710 - protein, 11 aa, Artificial Sequence
  Synthetic Peptide
GGNNIGSQNVH

SEQ ID NO: 711 - protein, 7 aa, Artificial Sequence
  Synthetic Peptide
RDSNRPS

SEQ ID NO: 712 - protein, 9 aa, Artificial Sequence
  Synthetic Peptide
QVWDSSTVV

SEQ ID NO: 713 - protein, 5 aa, Artificial Sequence
  Synthetic Peptide
RNGMH

SEQ ID NO: 714 - protein, 17 aa, Artificial Sequence
  Synthetic Peptide
VISNDGSNKYYADSVKG

SEQ ID NO: 715 - protein, 19 aa, Artificial Sequence
  Synthetic Peptide
VYYGSGIYYKNRYYYGMDV

SEQ ID NO: 716 - protein, 11 aa, Artificial Sequence
  Synthetic Peptide
GGNNIGSKNVH

SEQ ID NO: 717 - protein, 7 aa, Artificial Sequence
  Synthetic Peptide
RDSNRPS

SEQ ID NO: 718 - protein, 9 aa, Artificial Sequence
  Synthetic Peptide
QVWDSSTVV

SEQ ID NO: 719 - protein, 5 aa, Artificial Sequence
  Synthetic Peptide
NYGMH

SEQ ID NO: 720 - protein, 17 aa, Artificial Sequence
  Synthetic Peptide
VISYDGSNKYYADSVKG

SEQ ID NO: 721 - protein, 19 aa, Artificial Sequence
  Synthetic Peptide
VYYGSGIYYKKRYYYGMDV

SEQ ID NO: 722 - protein, 11 aa, Artificial Sequence
  Synthetic Peptide
GGNNIGSKNVH

SEQ ID NO: 723 - protein, 7 aa, Artificial Sequence
  Synthetic Peptide
RNSNRPS

SEQ ID NO: 724 - protein, 9 aa, Artificial Sequence
  Synthetic Peptide
QIWDSSTVV

SEQ ID NO: 725 - protein, 5 aa, Artificial Sequence
  Synthetic Peptide
RNGMH

SEQ ID NO: 726 - protein, 17 aa, Artificial Sequence
  Synthetic Peptide
VISNDGSNKYYADSVKG

SEQ ID NO: 727 - protein, 19 aa, Artificial Sequence
  Synthetic Peptide
VYYGSGIYYKKNYYYGMDV

SEQ ID NO: 728 - protein, 11 aa, Artificial Sequence
  Synthetic Peptide
GGNNIGSKNVH

SEQ ID NO: 729 - protein, 7 aa, Artificial Sequence
  Synthetic Peptide
RDSNRPS

SEQ ID NO: 730 - protein, 9 aa, Artificial Sequence
  Synthetic Peptide
QVWDSSTVV

SEQ ID NO: 731 - protein, 5 aa, Artificial Sequence
  Synthetic Peptide
NNGMH

SEQ ID NO: 732 - protein, 17 aa, Artificial Sequence
  Synthetic Peptide
VISYDGSNKYYTDSVKG

SEQ ID NO: 733 - protein, 19 aa, Artificial Sequence
  Synthetic Peptide
VYYGSGIYYKKRYYYGMDV

SEQ ID NO: 734 - protein, 11 aa, Artificial Sequence
  Synthetic Peptide
EGNNIGSQNVH

SEQ ID NO: 735 - protein, 7 aa, Artificial Sequence
  Synthetic Peptide
RDSNRPS

SEQ ID NO: 736 - protein, 9 aa, Artificial Sequence
  Synthetic Peptide
QVWDGSAVV

SEQ ID NO: 737 - protein, 5 aa, Artificial Sequence
  Synthetic Peptide
SYGMH

SEQ ID NO: 738 - protein, 17 aa, Artificial Sequence
  Synthetic Peptide
VISYDGSNKYYADSVKG

SEQ ID NO: 739 - protein, 19 aa, Artificial Sequence
  Synthetic Peptide
VYYGSGIYYKKRYYYGMDV

SEQ ID NO: 740 - protein, 11 aa, Artificial Sequence
  Synthetic Peptide
EGNNIGSQNVH

SEQ ID NO: 741 - protein, 7 aa, Artificial Sequence
  Synthetic Peptide
RDSNRPS

SEQ ID NO: 742 - protein, 9 aa, Artificial Sequence
  Synthetic Peptide
QVWDGSAVV

SEQ ID NO: 743 - protein, 5 aa, Artificial Sequence
  Synthetic Peptide
NYGFH

SEQ ID NO: 744 - protein, 17 aa, Artificial Sequence
  Synthetic Peptide
VISYDGSNRYYADSVKG

SEQ ID NO: 745 - protein, 19 aa, Artificial Sequence
  Synthetic Peptide
VYYGSGTYYKNRYYYGMDV

SEQ ID NO: 746 - protein, 11 aa, Artificial Sequence
  Synthetic Peptide
GGHNIGSKGVH

SEQ ID NO: 747 - protein, 7 aa, Artificial Sequence
  Synthetic Peptide
RNSNRPS

SEQ ID NO: 748 - protein, 9 aa, Artificial Sequence
  Synthetic Peptide
QAWDSGTVV

SEQ ID NO: 749 - protein, 5 aa, Artificial Sequence
  Synthetic Peptide
NYGFH

SEQ ID NO: 750 - protein, 17 aa, Artificial Sequence
  Synthetic Peptide
VISYDGSNRYYADSVKG

SEQ ID NO: 751 - protein, 19 aa, Artificial Sequence
  Synthetic Peptide
VYYGSGTYYKNRYYYGMDV

SEQ ID NO: 752 - protein, 11 aa, Artificial Sequence
  Synthetic Peptide
GANNIGSKNVH

SEQ ID NO: 753 - protein, 7 aa, Artificial Sequence
  Synthetic Peptide
RDFNRPS

SEQ ID NO: 754 - protein, 11 aa, Artificial Sequence
  Synthetic Peptide
QVWDSSTGNVV

SEQ ID NO: 755 - protein, 5 aa, Artificial Sequence
  Synthetic Peptide
NYGFH

SEQ ID NO: 756 - protein, 17 aa, Artificial Sequence
  Synthetic Peptide
VISYDGSNKYYADSVKG

SEQ ID NO: 757 - protein, 19 aa, Artificial Sequence
  Synthetic Peptide
VYYGSGSYYKNRYYYGMDV

SEQ ID NO: 758 - protein, 11 aa, Artificial Sequence
  Synthetic Peptide
GGNNIGSKNVH

SEQ ID NO: 759 - protein, 7 aa, Artificial Sequence
  Synthetic Peptide
RDSNRPS

SEQ ID NO: 760 - protein, 9 aa, Artificial Sequence
  Synthetic Peptide
QVWDSSTVV

SEQ ID NO: 761 - protein, 5 aa, Artificial Sequence
  Synthetic Peptide
NYGMH

SEQ ID NO: 762 - protein, 17 aa, Artificial Sequence
  Synthetic Peptide
VISYDGSNKYYADSVKG

SEQ ID NO: 763 - protein, 19 aa, Artificial Sequence
  Synthetic Peptide
VYYGSGIYYKKRYYYGMDV

SEQ ID NO: 764 - protein, 11 aa, Artificial Sequence
  Synthetic Peptide
GGNNIGSKNVH

SEQ ID NO: 765 - protein, 7 aa, Artificial Sequence
  Synthetic Peptide
RDSNRPS

SEQ ID NO: 766 - protein, 11 aa, Artificial Sequence
  Synthetic Peptide
QVWDSSSAHVI

SEQ ID NO: 767 - protein, 5 aa, Artificial Sequence
  Synthetic Peptide
GYGMH

SEQ ID NO: 768 - protein, 17 aa, Artificial Sequence
  Synthetic Peptide
VISYDGSNKYYADSVKG

SEQ ID NO: 769 - protein, 19 aa, Artificial Sequence
  Synthetic Peptide
VYYGSGIYYKNRYYYGMDV

SEQ ID NO: 770 - protein, 11 aa, Artificial Sequence
  Synthetic Peptide
GGNNLGSKNVH

SEQ ID NO: 771 - protein, 7 aa, Artificial Sequence
  Synthetic Peptide
RNSNRPS

SEQ ID NO: 772 - protein, 9 aa, Artificial Sequence
  Synthetic Peptide
QVWDSSTVV

SEQ ID NO: 773 - protein, 5 aa, Artificial Sequence
  Synthetic Peptide
NNGMH

SEQ ID NO: 774 - protein, 17 aa, Artificial Sequence
  Synthetic Peptide
VISYDGSNKYYADSVKG

SEQ ID NO: 775 - protein, 19 aa, Artificial Sequence
  Synthetic Peptide
VYYGSGIYYKNRYYYGMDV

SEQ ID NO: 776 - protein, 11 aa, Artificial Sequence
  Synthetic Peptide
GGNRIGSKNVH

SEQ ID NO: 777 - protein, 7 aa, Artificial Sequence
  Synthetic Peptide
RDSNRPS

SEQ ID NO: 778 - protein, 9 aa, Artificial Sequence
  Synthetic Peptide
QVWDSSTVV

SEQ ID NO: 779 - protein, 5 aa, Artificial Sequence
  Synthetic Peptide
NYGFH

SEQ ID NO: 780 - protein, 17 aa, Artificial Sequence
  Synthetic Peptide
VISYDGSNRYYADSVKG

SEQ ID NO: 781 - protein, 19 aa, Artificial Sequence
  Synthetic Peptide
VYYGSGTYYKNRYYYGMDV

SEQ ID NO: 782 - protein, 11 aa, Artificial Sequence
  Synthetic Peptide
GGHNIGSKGVH

SEQ ID NO: 783 - protein, 7 aa, Artificial Sequence
  Synthetic Peptide
RNSNRPS

SEQ ID NO: 784 - protein, 9 aa, Artificial Sequence
  Synthetic Peptide
QVWDSSTVV

SEQ ID NO: 785 - protein, 5 aa, Artificial Sequence
  Synthetic Peptide
NYGMH

SEQ ID NO: 786 - protein, 17 aa, Artificial Sequence
  Synthetic Peptide
VISYDGSNKYYADSVKG

SEQ ID NO: 787 - protein, 19 aa, Artificial Sequence
  Synthetic Peptide
VYYGSGIYYKNRYYYGMDV

SEQ ID NO: 788 - protein, 11 aa, Artificial Sequence
  Synthetic Peptide
GGHNIGSKGVH

SEQ ID NO: 789 - protein, 7 aa, Artificial Sequence
  Synthetic Peptide
RNSNRPS

SEQ ID NO: 790 - protein, 9 aa, Artificial Sequence
  Synthetic Peptide
QVWDSSTVV

SEQ ID NO: 791 - protein, 5 aa, Artificial Sequence
  Synthetic Peptide
NNGMH

SEQ ID NO: 792 - protein, 17 aa, Artificial Sequence
  Synthetic Peptide
VISNDGSNKYYADSVRG

SEQ ID NO: 793 - protein, 19 aa, Artificial Sequence
  Synthetic Peptide
VYYGSGIYYKNRYYYGMDV

SEQ ID NO: 794 - protein, 11 aa, Artificial Sequence
  Synthetic Peptide
GGNNIGSKNVH

SEQ ID NO: 795 - protein, 7 aa, Artificial Sequence
  Synthetic Peptide
RNSNRPS

SEQ ID NO: 796 - protein, 9 aa, Artificial Sequence
  Synthetic Peptide
QVWDSSTVV

SEQ ID NO: 797 - protein, 5 aa, Artificial Sequence
  Synthetic Peptide
NNGMH

SEQ ID NO: 798 - protein, 17 aa, Artificial Sequence
  Synthetic Peptide
VISNDGSNKYYADSVRG

SEQ ID NO: 799 - protein, 19 aa, Artificial Sequence
  Synthetic Peptide
VYYGSGIYYKNRYYYGMDV

SEQ ID NO: 800 - protein, 11 aa, Artificial Sequence
  Synthetic Peptide
EGNNIGSKNVH

SEQ ID NO: 801 - protein, 7 aa, Artificial Sequence
  Synthetic Peptide
RDSNRPS

SEQ ID NO: 802 - protein, 9 aa, Artificial Sequence
  Synthetic Peptide
QVWDSSAVV

SEQ ID NO: 803 - protein, 5 aa, Artificial Sequence
  Synthetic Peptide
SSGMH

SEQ ID NO: 804 - protein, 17 aa, Artificial Sequence
  Synthetic Peptide
VISNDGSNKYYADSVKG

SEQ ID NO: 805 - protein, 19 aa, Artificial Sequence
  Synthetic Peptide
VYYGSGIYYKNNYYYGMDV

SEQ ID NO: 806 - protein, 11 aa, Artificial Sequence
  Synthetic Peptide
GGNNIGSKNVH

SEQ ID NO: 807 - protein, 7 aa, Artificial Sequence
  Synthetic Peptide
RNSNRPS

SEQ ID NO: 808 - protein, 9 aa, Artificial Sequence
  Synthetic Peptide
QAWDSSTVV

SEQ ID NO: 809 - protein, 5 aa, Artificial Sequence
  Synthetic Peptide
NYGMH

SEQ ID NO: 810 - protein, 17 aa, Artificial Sequence
  Synthetic Peptide
VISYDGSNKYYADSVKG

SEQ ID NO: 811 - protein, 19 aa, Artificial Sequence
  Synthetic Peptide
VYYGSGIYYKKRYYYGMDV

SEQ ID NO: 812 - protein, 11 aa, Artificial Sequence
  Synthetic Peptide
GGNNIGSQNVH

SEQ ID NO: 813 - protein, 7 aa, Artificial Sequence
  Synthetic Peptide
RDSNRPS

SEQ ID NO: 814 - protein, 9 aa, Artificial Sequence
  Synthetic Peptide
QVWDSSAVV

SEQ ID NO: 815 - protein, 5 aa, Artificial Sequence
  Synthetic Peptide
SSGMH

SEQ ID NO: 816 - protein, 17 aa, Artificial Sequence
  Synthetic Peptide
VISNDGSNKYYADSVKG

SEQ ID NO: 817 - protein, 19 aa, Artificial Sequence
  Synthetic Peptide
VYYGSGIYYKNRYYYGMDV

SEQ ID NO: 818 - protein, 11 aa, Artificial Sequence
  Synthetic Peptide
GGNNIGSKNVH

SEQ ID NO: 819 - protein, 7 aa, Artificial Sequence
  Synthetic Peptide
RDSNRPS

SEQ ID NO: 820 - protein, 9 aa, Artificial Sequence
  Synthetic Peptide
QAWDSGTVV

SEQ ID NO: 821 - protein, 5 aa, Artificial Sequence
  Synthetic Peptide
NYGMH

SEQ ID NO: 822 - protein, 17 aa, Artificial Sequence
  Synthetic Peptide
VISYDGSNKYYADSVKG

SEQ ID NO: 823 - protein, 19 aa, Artificial Sequence
  Synthetic Peptide
VYYGSGIYYKKRYYYGMDV

SEQ ID NO: 824 - protein, 11 aa, Artificial Sequence
  Synthetic Peptide
GGNNIGGKNVH

SEQ ID NO: 825 - protein, 7 aa, Artificial Sequence
  Synthetic Peptide
RDSNRPS

SEQ ID NO: 826 - protein, 9 aa, Artificial Sequence
  Synthetic Peptide
QVWDSSTVV

SEQ ID NO: 827 - protein, 5 aa, Artificial Sequence
  Synthetic Peptide
RNGMH

SEQ ID NO: 828 - protein, 17 aa, Artificial Sequence
  Synthetic Peptide
VISNDGSNKYYADSVKG

SEQ ID NO: 829 - protein, 19 aa, Artificial Sequence
  Synthetic Peptide
VYYGSGIYYKNNYYYGMDV

SEQ ID NO: 830 - protein, 11 aa, Artificial Sequence
  Synthetic Peptide
GGNNIGSKNVH

SEQ ID NO: 831 - protein, 7 aa, Artificial Sequence
  Synthetic Peptide
RNSNRPS

SEQ ID NO: 832 - protein, 9 aa, Artificial Sequence
  Synthetic Peptide
QVWDSSTVV

SEQ ID NO: 833 - protein, 5 aa, Artificial Sequence
  Synthetic Peptide
RNGMH

SEQ ID NO: 834 - protein, 17 aa, Artificial Sequence
  Synthetic Peptide
VISNDGSNKYYADSVKG

SEQ ID NO: 835 - protein, 19 aa, Artificial Sequence
  Synthetic Peptide
VYYGSGIYYKNNYYYGMDV

SEQ ID NO: 836 - protein, 11 aa, Artificial Sequence
  Synthetic Peptide
GGNNIESKNVH

SEQ ID NO: 837 - protein, 7 aa, Artificial Sequence
  Synthetic Peptide
RDSNRPS

SEQ ID NO: 838 - protein, 9 aa, Artificial Sequence
  Synthetic Peptide
QVWDSSTVV

SEQ ID NO: 839 - protein, 5 aa, Artificial Sequence
  Synthetic Peptide
NARMG

SEQ ID NO: 840 - protein, 19 aa, Artificial Sequence
  Synthetic Peptide
RIKSKTEGGTRDYAAPVKG

SEQ ID NO: 841 - protein, 4 aa, Artificial Sequence
  Synthetic Peptide
YSGV

SEQ ID NO: 842 - protein, 17 aa, Artificial Sequence
  Synthetic Peptide
KSSQSVLYSSNNRNYLA

SEQ ID NO: 843 - protein, 7 aa, Artificial Sequence
  Synthetic Peptide
WASTRES

SEQ ID NO: 844 - protein, 9 aa, Artificial Sequence
  Synthetic Peptide
QQYYSIPIT

SEQ ID NO: 845 - protein, 5 aa, Artificial Sequence
  Synthetic Peptide
NYGFH

SEQ ID NO: 846 - protein, 17 aa, Artificial Sequence
  Synthetic Peptide
VISYDGSNRYYASSVKG

SEQ ID NO: 847 - protein, 19 aa, Artificial Sequence
  Synthetic Peptide
VYYGSGTYYKNRYYYGMDV

SEQ ID NO: 848 - protein, 11 aa, Artificial Sequence
  Synthetic Peptide
GGHNIGSKGVH

SEQ ID NO: 849 - protein, 7 aa, Artificial Sequence
  Synthetic Peptide
RAANRPS

SEQ ID NO: 850 - protein, 9 aa, Artificial Sequence
  Synthetic Peptide
QAFDAGTVV

SEQ ID NO: 851 - protein, 5 aa, Artificial Sequence
  Synthetic Peptide
NYGFH

SEQ ID NO: 852 - protein, 17 aa, Artificial Sequence
  Synthetic Peptide
VISYAGSNRYYAASVKG

SEQ ID NO: 853 - protein, 19 aa, Artificial Sequence
  Synthetic Peptide
VYYGSGTYYKNRYYYGMDV

SEQ ID NO: 854 - protein, 11 aa, Artificial Sequence
  Synthetic Peptide
GGHNIGSKGVH

SEQ ID NO: 855 - protein, 7 aa, Artificial Sequence
  Synthetic Peptide
RQSNRPS

SEQ ID NO: 856 - protein, 9 aa, Artificial Sequence
  Synthetic Peptide
QAFDAGTVV

SEQ ID NO: 857 - protein, 5 aa, Artificial Sequence
  Synthetic Peptide
NYGFH

SEQ ID NO: 858 - protein, 17 aa, Artificial Sequence
  Synthetic Peptide
VISYSGSNRYYADSVKG

SEQ ID NO: 859 - protein, 19 aa, Artificial Sequence
  Synthetic Peptide
VYYGSGTYYKNRYYYGMDV

SEQ ID NO: 860 - protein, 11 aa, Artificial Sequence
  Synthetic Peptide
GGHNIGSKGVH

SEQ ID NO: 861 - protein, 7 aa, Artificial Sequence
  Synthetic Peptide
RQSNRPS

SEQ ID NO: 862 - protein, 9 aa, Artificial Sequence
  Synthetic Peptide
QAFDAGTVV

SEQ ID NO: 863 - protein, 11 aa, Artificial Sequence
  Synthetic Peptide
GGHNIGSKGVH

SEQ ID NO: 864 - protein, 7 aa, Artificial Sequence
  Synthetic Peptide
RNSNRPS

SEQ ID NO: 865 - protein, 9 aa, Artificial Sequence
  Synthetic Peptide
QVWDISTVV

SEQ ID NO: 866 - protein, 5 aa, Artificial Sequence
  Synthetic Peptide
NCGMH

SEQ ID NO: 867 - protein, 17 aa, Artificial Sequence
  Synthetic Peptide
VISYDGGNKYHADSVKG

SEQ ID NO: 868 - protein, 19 aa, Artificial Sequence
  Synthetic Peptide
VYYGSGIYYKNRYYYGMDV

SEQ ID NO: 869 - protein, 11 aa, Artificial Sequence
  Synthetic Peptide
GGHNIGSKGVH

SEQ ID NO: 870 - protein, 7 aa, Artificial Sequence
  Synthetic Peptide
RNSNRPS

SEQ ID NO: 871 - protein, 9 aa, Artificial Sequence
  Synthetic Peptide
QVWDSSTVV

SEQ ID NO: 872 - protein, 5 aa, Artificial Sequence
  Synthetic Peptide
NCGMH

SEQ ID NO: 873 - protein, 17 aa, Artificial Sequence
  Synthetic Peptide
VISYDGGNKYYADSVKG

SEQ ID NO: 874 - protein, 19 aa, Artificial Sequence
  Synthetic Peptide
VYYGSGIYYKNRYYYGMDV

SEQ ID NO: 875 - protein, 11 aa, Artificial Sequence
  Synthetic Peptide
GGNNIGSKNVH

SEQ ID NO: 876 - protein, 7 aa, Artificial Sequence
  Synthetic Peptide
RDSNRPS

SEQ ID NO: 877 - protein, 9 aa, Artificial Sequence
  Synthetic Peptide
QVWDSNTVV

SEQ ID NO: 878 - protein, 5 aa, Artificial Sequence
  Synthetic Peptide
NNGMH

SEQ ID NO: 879 - protein, 17 aa, Artificial Sequence
  Synthetic Peptide
VISNDGSNKYYADSVRG

SEQ ID NO: 880 - protein, 19 aa, Artificial Sequence
  Synthetic Peptide
VYYGSGIYYKNNYYYGMDV

SEQ ID NO: 881 - protein, 11 aa, Artificial Sequence
  Synthetic Peptide
GGNNIGSKNVH

SEQ ID NO: 882 - protein, 7 aa, Artificial Sequence
  Synthetic Peptide
RNSNRPS

SEQ ID NO: 883 - protein, 9 aa, Artificial Sequence
  Synthetic Peptide
QVWDSSTVV

SEQ ID NO: 884 - protein, 5 aa, Artificial Sequence
  Synthetic Peptide
TYGMH

SEQ ID NO: 885 - protein, 17 aa, Artificial Sequence
  Synthetic Peptide
VISYDGSNKYYADSVKG

SEQ ID NO: 886 - protein, 19 aa, Artificial Sequence
  Synthetic Peptide
VYYGSGSYYKKNYYYGMDV

SEQ ID NO: 887 - protein, 11 aa, Artificial Sequence
  Synthetic Peptide
GGNNIGGKNVH

SEQ ID NO: 888 - protein, 7 aa, Artificial Sequence
  Synthetic Peptide
RDSNRPS

SEQ ID NO: 889 - protein, 9 aa, Artificial Sequence
  Synthetic Peptide
QVWDSSTVV

SEQ ID NO: 890 - protein, 5 aa, Artificial Sequence
  Synthetic Peptide
SYGFH

SEQ ID NO: 891 - protein, 17 aa, Artificial Sequence
  Synthetic Peptide
VISYDGSNKYYADSVKG

SEQ ID NO: 892 - protein, 19 aa, Artificial Sequence
  Synthetic Peptide
VYYGSGTYYKNRYYYGMDV

SEQ ID NO: 893 - protein, 11 aa, Artificial Sequence
  Synthetic Peptide
GGNNIGSKNVH

SEQ ID NO: 894 - protein, 7 aa, Artificial Sequence
  Synthetic Peptide
RDSNRPS

SEQ ID NO: 895 - protein, 9 aa, Artificial Sequence
  Synthetic Peptide
QVWDSSTVV

SEQ ID NO: 896 - protein, 5 aa, Artificial Sequence
  Synthetic Peptide
NNGMH

SEQ ID NO: 897 - protein, 17 aa, Artificial Sequence
  Synthetic Peptide
VISNDGSNKYYPDSVKG

SEQ ID NO: 898 - protein, 19 aa, Artificial Sequence
  Synthetic Peptide
VYYGSGNYYKNNYYYGMDV

SEQ ID NO: 899 - protein, 11 aa, Artificial Sequence
  Synthetic Peptide
EGNNIGSQNVH

SEQ ID NO: 900 - protein, 7 aa, Artificial Sequence
  Synthetic Peptide
RDSNRPS

SEQ ID NO: 901 - protein, 9 aa, Artificial Sequence
  Synthetic Peptide
QVWDGSAVV

SEQ ID NO: 902 - protein, 5 aa, Artificial Sequence
  Synthetic Peptide
SSGMH

SEQ ID NO: 903 - protein, 17 aa, Artificial Sequence
  Synthetic Peptide
VISHDGSNKYYADSVKG

SEQ ID NO: 904 - protein, 19 aa, Artificial Sequence
  Synthetic Peptide
VYYGSGIYYKNRYYYGMDV

SEQ ID NO: 905 - protein, 11 aa, Artificial Sequence
  Synthetic Peptide
GGHNIGSKGVH

SEQ ID NO: 906 - protein, 7 aa, Artificial Sequence
  Synthetic Peptide
RNSNRPS

SEQ ID NO: 907 - protein, 9 aa, Artificial Sequence
  Synthetic Peptide
QVWDSSTVV

SEQ ID NO: 908 - protein, 5 aa, Artificial Sequence
  Synthetic Peptide
DCGMH

SEQ ID NO: 909 - protein, 17 aa, Artificial Sequence
  Synthetic Peptide
VISYDGGNKYYADSVKG

SEQ ID NO: 910 - protein, 19 aa, Artificial Sequence
  Synthetic Peptide
VYYGSGIYYKNRYYYGMDV

SEQ ID NO: 911 - protein, 11 aa, Artificial Sequence
  Synthetic Peptide
GGNNIGSKNVH

SEQ ID NO: 912 - protein, 7 aa, Artificial Sequence
  Synthetic Peptide
RSSNRPS

SEQ ID NO: 913 - protein, 9 aa, Artificial Sequence
  Synthetic Peptide
QIWDSSTVV

SEQ ID NO: 914 - protein, 5 aa, Artificial Sequence
  Synthetic Peptide
SYGMH

SEQ ID NO: 915 - protein, 17 aa, Artificial Sequence
  Synthetic Peptide
VISFDGNNKYYADSVKG

SEQ ID NO: 916 - protein, 19 aa, Artificial Sequence
  Synthetic Peptide
VYYGSGSYYKNRYYYGMDV

SEQ ID NO: 917 - protein, 11 aa, Artificial Sequence
  Synthetic Peptide
GGNNIGSKNVH

SEQ ID NO: 918 - protein, 7 aa, Artificial Sequence
  Synthetic Peptide
RDSNRPS

SEQ ID NO: 919 - protein, 9 aa, Artificial Sequence
  Synthetic Peptide
QVWDSSTVV

SEQ ID NO: 920 - protein, 5 aa, Artificial Sequence
  Synthetic Peptide
SNGMH

SEQ ID NO: 921 - protein, 17 aa, Artificial Sequence
  Synthetic Peptide
VISNDGSNKYYGDSVKG

SEQ ID NO: 922 - protein, 19 aa, Artificial Sequence
  Synthetic Peptide
VYYGSGIYYRNNYYYGMDV

SEQ ID NO: 923 - protein, 11 aa, Artificial Sequence
  Synthetic Peptide
GGNNIGSKNVH

SEQ ID NO: 924 - protein, 7 aa, Artificial Sequence
  Synthetic Peptide
RNTNRPS

SEQ ID NO: 925 - protein, 9 aa, Artificial Sequence
  Synthetic Peptide
QVWDSSTVV

SEQ ID NO: 926 - protein, 5 aa, Artificial Sequence
  Synthetic Peptide
GYGMH

SEQ ID NO: 927 - protein, 17 aa, Artificial Sequence
  Synthetic Peptide
VISYDGSNKYYADSVKG

SEQ ID NO: 928 - protein, 19 aa, Artificial Sequence
  Synthetic Peptide
VYYGSGIYYKNRYYYGMDV

SEQ ID NO: 929 - protein, 11 aa, Artificial Sequence
  Synthetic Peptide
GGNNIGSKNVH

SEQ ID NO: 930 - protein, 7 aa, Artificial Sequence
  Synthetic Peptide
RNTNRPS

SEQ ID NO: 931 - protein, 9 aa, Artificial Sequence
  Synthetic Peptide
QVWDSSTVV

SEQ ID NO: 932 - protein, 5 aa, Artificial Sequence
  Synthetic Peptide
GYGMH

SEQ ID NO: 933 - protein, 17 aa, Artificial Sequence
  Synthetic Peptide
VISYDGSNKYYADSVKG

SEQ ID NO: 934 - protein, 19 aa, Artificial Sequence
  Synthetic Peptide
VYYGSGIYYKNRYYYGMDV

SEQ ID NO: 935 - protein, 11 aa, Artificial Sequence
  Synthetic Peptide
GGNNIGDKNVH

SEQ ID NO: 936 - protein, 7 aa, Artificial Sequence
  Synthetic Peptide
RNNVRPS

SEQ ID NO: 937 - protein, 9 aa, Artificial Sequence
  Synthetic Peptide
QVWDSSTVV

SEQ ID NO: 938 - protein, 5 aa, Artificial Sequence
  Synthetic Peptide
NFGMH

SEQ ID NO: 939 - protein, 17 aa, Artificial Sequence
  Synthetic Peptide
VISYDGGNKYYADSVKG

SEQ ID NO: 940 - protein, 19 aa, Artificial Sequence
  Synthetic Peptide
VYYGSGSYYKKRYYYGMDV

SEQ ID NO: 941 - protein, 11 aa, Artificial Sequence
  Synthetic Peptide
GGNNIGSKNVH

SEQ ID NO: 942 - protein, 7 aa, Artificial Sequence
  Synthetic Peptide
RDSNRPS

SEQ ID NO: 943 - protein, 9 aa, Artificial Sequence
  Synthetic Peptide
QVWDSSTVV

SEQ ID NO: 944 - protein, 5 aa, Artificial Sequence
  Synthetic Peptide
SCGMH

SEQ ID NO: 945 - protein, 17 aa, Artificial Sequence
  Synthetic Peptide
VISYDGTNKYYADSVKG

SEQ ID NO: 946 - protein, 19 aa, Artificial Sequence
  Synthetic Peptide
VYYGSGIYYKKNYYYGMDV

SEQ ID NO: 947 - protein, 5 aa, Artificial Sequence
  Synthetic Peptide
NARMG

SEQ ID NO: 948 - protein, 19 aa, Artificial Sequence
  Synthetic Peptide
RIKSKTEGGTRDYAAPVKG

SEQ ID NO: 949 - protein, 4 aa, Artificial Sequence
  Synthetic Peptide
YSGV

SEQ ID NO: 950 - protein, 17 aa, Artificial Sequence
  Synthetic Peptide
KSSQSVLYSSNNKNYLA

SEQ ID NO: 951 - protein, 7 aa, Artificial Sequence
  Synthetic Peptide
WASTRES

SEQ ID NO: 952 - protein, 9 aa, Artificial Sequence
  Synthetic Peptide
QQYYSIPIT

SEQ ID NO: 953 - protein, 128 aa, Artificial Sequence
  Synthetic Peptide
QVQLVESGGGVVQPGRSLRLSCVVSGFNFSNNGMHWVRQAPGKGLEWVAVISNDGSNKYYADSVKGRFTISRDNSKNTLYLQMNSLRTEDTAVYYCAKVYYGSGIYYKNRNYYGMDVWGQGTTVTVSS

SEQ ID NO: 954 - protein, 106 aa, Artificial Sequence
  Synthetic Peptide
SYELTQPPSVSVALGQTARITCGGNNIGSQNVHWYQQKPGQAPVLVIYRDSNRPSGIPDRFSGSKSGNTATLTISRAQAGDEADYYCQVWDSSTVVFGGGTKLTVL

SEQ ID NO: 955 - protein, 128 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSS

SEQ ID NO: 956 - protein, 106 aa, Artificial Sequence
  Synthetic Peptide
SYELTQPPSVSVALGQTARITCGGHNIGSKGVHWYQQKPGQAPVLVIYRNSNRPSGIPERFSGSNSGNTATLTITRAQAGDEADYYCQVWDSSTVVFGGGTKLTVL

SEQ ID NO: 957 - protein, 128 aa, Artificial Sequence
  Synthetic Peptide
QVQLVESGGGVVQPGRSLRLSCAPSGFNFSNYGMHWVRQAPGKGLEWVAVISYDGSNKYYADSVKGRFTISRDNSKNTLFLQMNSLRAEDTAVYFCARVYYGSGSYYKKRYYYGMDVWGQGTTVTVSS

SEQ ID NO: 958 - protein, 106 aa, Artificial Sequence
  Synthetic Peptide
SYELTQPPSVSVALGQTARITCGGNNIGSQNVHWYQQKPGQAPVLVIYRDSNRPSGIPERFSGSKSGNTATLTISRAQAGDEADYYCQVWDSSTVVFGGGTQLTVL

SEQ ID NO: 959 - protein, 128 aa, Artificial Sequence
  Synthetic Peptide
QVQLVESGGGVVQPGRSLRLSCAASGFTFSSSGMHWVRQAPGKGLEWVAVISYDGTNKYYADSVKGRFTISRDNSKNTLYLQMNSLRAEDTAVYYCAKVYYGSGIYYKNRYYYGMDVWGQGTTVTVSS

SEQ ID NO: 960 - protein, 106 aa, Artificial Sequence
  Synthetic Peptide
SYELTQPPSVSVALGQTARITCGGHNIGSKGVHWYQQKPGQAPVLVIYRNSNRPSGIPERFSGSNSGNTATLTISRAQAGDEADYYCQVWDSSTVVFGGGTQLTVL

SEQ ID NO: 961 - protein, 128 aa, Artificial Sequence
  Synthetic Peptide
QVQLVESGGGVVQPGRSLRLSCAVSGFNFSNYGMHWVRQVPGRGLDWVAVISNDGSNKYYADSVKGRFTISRDNSKNTLYLQMDSLRTEDTAVYYCAKVYYGSGIYYKKRYYYGMDVWGQGTTVTVSS

SEQ ID NO: 962 - protein, 106 aa, Artificial Sequence
  Synthetic Peptide
SYELTQPPSVSVALGQTARITCGGHNIGSQNVHWYQQKPGQAPVLVIYRDSNRPSGIPERFSGSKSGNTATLTISRAQAGDEADYYCQVWDSSTVVFGGGTQLTVL

SEQ ID NO: 963 - protein, 128 aa, Artificial Sequence; identical to SEQ ID NO: 955
  Synthetic Peptide

SEQ ID NO: 964 - protein, 106 aa, Artificial Sequence
  Synthetic Peptide
SYELTQPPSVSVAPGQTARITCGGNNIGSKNVHWYQQKAGQAPVQVIYRNSNRPSGIPARFSGSNSGNTATLTISRAQAGDEADYYCQVWDSSTVVFGGGTKLTVL

SEQ ID NO: 965 - protein, 128 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRGEDTAVYYCARVYYGSGSYYKNRYYYGMDVWGQGTTVTVSS

SEQ ID NO: 966 - protein, 105 aa, Artificial Sequence
  Synthetic Peptide
SYELTQPPSVSVAPGQTARIPCGGNNIGSKNVHWYQQKPGQAPVLVIYRDINRPSGIPERFSGSNSGNTATLTISRAQAGDEADYYCQVWDSSVVFGGGTKLTVL

SEQ ID NO: 967 - protein, 128 aa, Artificial Sequence; identical to SEQ ID NO: 955
  Synthetic Peptide

SEQ ID NO: 968 - protein, 106 aa, Artificial Sequence
  Synthetic Peptide
SYELTQPPSVSVALGQTARLTCEGNNIGSKNVHWYQQKPGQAPVLVIYRNSNRPSGIPERFSGSNSGNTATLTISRVQAGDEADYYCQAWDSSTVVFGGGTQLTVL

SEQ ID NO: 969 - protein, 128 aa, Artificial Sequence
  Synthetic Peptide
QVQLVESGGGLVKPGGSLRLSCAVSGFNFSNNGMHWVRQAPGKGLEWVAVISYDGSNKYYTDSVKGRFTISRDNSKNTLYLQMNSLRTEDTAVYYCAKVYYGSGIYYKKRYYYGMDVWGQGTTVTVSS

SEQ ID NO: 970 - protein, 108 aa, Artificial Sequence
  Synthetic Peptide
SYELTQPLSVSEALGQTARITCGGNNIGSKNVHWYQQKPGQAPVLVIYRDSNRPSGIPERFSGSNSGNAATLTISRVEAGDEADYYCQVWDSSSDHVVFGGGTQLTVL

SEQ ID NO: 971 - protein, 128 aa, Artificial Sequence; identical to SEQ ID NO: 955
  Synthetic Peptide

SEQ ID NO: 972 - protein, 106 aa, Artificial Sequence
  Synthetic Peptide
SYELTQPPSVSVAPGQTARITCGGNNIGSKNVHWYQQKPGQAPVLVIYRNSNRPSGIPERFSGSNSGNTATLTISGTQAMDEADYYCQAWDSSNVVFGGGTQLTVL

SEQ ID NO: 973 - protein, 128 aa, Artificial Sequence
  Synthetic Peptide
QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSS

SEQ ID NO: 974 - protein, 106 aa, Artificial Sequence
  Synthetic Peptide
SYELTQPLSVSVALGQTARITCGGNNIGSQNVHWYQQKPGQAPVLVIYRDSNRPSGIPDRFSGSKSGNTATLTISRAQAGDEADYYCQVWDSSTVVFGGGTQLTVL

SEQ ID NO: 975 - protein, 128 aa, Artificial Sequence
  Synthetic Peptide
QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNRYYYGMDVWGQGTTVTVSS

SEQ ID NO: 976 - protein, 106 aa, Artificial Sequence
  Synthetic Peptide
SYELTQPPSVSVAPGQTARITCGGNNIGSKNVHWYQQKPGQAPVLVIYRDSNRPSGIPERFSGSKSGTTATLTISRAQAGDEAEYYCQVWDSSTVVFGGGTELTVL

SEQ ID NO: 977 - protein, 128 aa, Artificial Sequence; identical to SEQ ID NO: 955
  Synthetic Peptide

SEQ ID NO: 978 - protein, 106 aa, Artificial Sequence
  Synthetic Peptide
SYELTQPLSVSVALGQTARITCGGNNIGSKNVHWYQQKPGQAPVLAIYRNSNRPSGIPERFTGSNSGNTATLTISRAQAGDESDYYCQIWDSSTVVFGGGTKLTVL

SEQ ID NO: 979 - protein, 128 aa, Artificial Sequence
  Synthetic Peptide
QVQLVESGGGVVQPGRSLRLSCAASGFNFSRNGMHWVRQVPGRGLDWVAVISNDGSNKYYADSVKGRFTISRDNSKNTLYLQMNSLRAEDTAVYYCAKVYYGSGIYYKKNYYYGMDVWGQGTTVTVSS

SEQ ID NO: 980 - protein, 106 aa, Artificial Sequence
  Synthetic Peptide
SYELTQPPSVSVALGQTARISCGGNNIGSKNVHWYQQKPGQAPVLVIYRDSNRPSGIPERFSGSKSGTTATLTISRAQAGDEAEYYCQVWDSSTVVFGGGTQLTVL

SEQ ID NO: 981 - protein, 128 aa, Artificial Sequence
  Synthetic Peptide
QVQLVESGGGVVQPGRSLRLSCAVSGFNFSNNGMHWVRQAPGKGLEWVAVISYDGSNKYYTDSVKGRFTISRDNSKNTLYLQMNSLRTEDTAVYYCAKVYYGSGIYYKKRYYYGMDVWGQGTTVTVSS

SEQ ID NO: 982 - protein, 106 aa, Artificial Sequence
  Synthetic Peptide
SYELTQPPSVSVALGQTARITCEGNNIGSQNVHWYQQKPGQAPVLVMYRDSNRPSGIPERFSGSKSGNTATLAISRAQAGDESDYYCQVWDGSAVVFGGGTKLTVL

SEQ ID NO: 983 - protein, 128 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSS

SEQ ID NO: 984 - protein, 106 aa, Artificial Sequence
  Synthetic Peptide
SYELTQPLSVSVALGQTARITCEGNNIGSQNVHWYQQKPGQAPVLVMYRDSNRPSGIPERFSGSKSGNTATLAISRAQAGDESDYYCQVWDGSAVVFGGGTQLTVL

SEQ ID NO: 985 - protein, 128 aa, Artificial Sequence
  Synthetic Peptide
QVQLVESGGGVVQPGRSLRLSCAASGFTFSNYGFHWVRQTPGKGLEWVAVISYDGSNRYYADSVKGRFTISRDNSKNTLYLQMNSLRGEDTALYYCARVYYGSGTYYKNRYYYGMDVWGQGTTVTVSS

SEQ ID NO: 986 - protein, 106 aa, Artificial Sequence
  Synthetic Peptide
SYELTQPPSVSVALGQTARITCGGHNIGSKGVHWYQQKPGQAPVLVIYRNSNRPSGIPERFSGSNSGNTATLTISGTQAMDEADYYCQAWDSGTVVFGGGTQLTVL

SEQ ID NO: 987 - protein, 128 aa, Artificial Sequence; identical to SEQ ID NO: 985
  Synthetic Peptide

SEQ ID NO: 988 - protein, 108 aa, Artificial Sequence
  Synthetic Peptide
SYELTQPPSVSVALGQTARITCGANNIGSKNVHWYQQKPGQPPVLVIYRDFNRPSGIPERFSASNSGNTATLTISRGQAGDEADYYCQVWDSSTGNVVFGGGTKLTVL

SEQ ID NO: 989 - protein, 128 aa, Artificial Sequence
  Synthetic Peptide
QVQLVESGGGVVQPGRSLRLSCAASGFIFSNYGFHWVRQTPGKGLEWVAVISYDGSNKYYADSVKGRFTISRDNSKNTLYLQMNSLRGEDTAVYYCARVYYGSGSYYKNRYYYGMDVWGQGTTVTVSS

SEQ ID NO: 990 - protein, 106 aa, Artificial Sequence
  Synthetic Peptide
SYELTQPPSVSVAPGQTARITCGGNNIGSKNVHWYQQKPGQAPVLVIYRDSNRPSGIPERFSGSKSGTTATLTISRAQAGDEADYYCQVWDSSTVVFGGGTELTVL

SEQ ID NO: 991 - protein, 128 aa, Artificial Sequence; identical to SEQ ID NO: 955
  Synthetic Peptide

SEQ ID NO: 992 - protein, 108 aa, Artificial Sequence
  Synthetic Peptide
SYELTQSSSVSVAPGQTARITCGGNNIGSKNVHWYQQKPGQAPVLVIYRDSNRPSGIPERFSGSKSGTTATLTISRVEAGDEADYYCQVWDSSSAHVIFGGGTKLTVL

SEQ ID NO: 993 - protein, 128 aa, Artificial Sequence
  Synthetic Peptide
QVQLVESGGGVVQPGRSLRLSCGASGFTFSGYGMHWVRQAPGKGLEWVAVISYDGSNKYYADSVKGRFTISRDNSKNTLYLQMNSLRGEDTAVYYCARVYYGSGIYYKNRYYYGMDVWGQGTTVTVSS

SEQ ID NO: 994 - protein, 106 aa, Artificial Sequence
  Synthetic Peptide
SYELTQPPSGSVALGQTARITCGGNNLGSKNVHWYQQKPGQAPVLVIYRNSNRPSGIPERFSGSNSGNTATLTISRAQAGDEADYYCQVWDSSTVVFGGGTKLTVL

SEQ ID NO: 995 - protein, 128 aa, Artificial Sequence
  Synthetic Peptide
QVQLVESGGGLVKPGGSLRLSCAASGFTFSNNGMHWVRQAPGKGLEWVAVISYDGSNKYYADSVKGRFTISRDNSKNTLYLQMNSLRAEDTAVYYCAKVYYGSGIYYKNRYYYGMDVWGQGTTVTVSS

SEQ ID NO: 996 - protein, 106 aa, Artificial Sequence
  Synthetic Peptide
SYELTQPPSVSVALGQTARITCGGNRIGSKNVHWYQQKPGQAPVLVIYRDSNRPSGIPERFSGSKSGTTATLTISRAQAGDEAEYYCQVWDSSTVVFGGGTKLTVL

SEQ ID NO: 997 - protein, 128 aa, Artificial Sequence; identical to SEQ ID NO: 985
  Synthetic Peptide

SEQ ID NO: 998 - protein, 106 aa, Artificial Sequence
  Synthetic Peptide
SYELTQLPSVSVALGQTARITCGGHNIGSKGVHWYQQKPGQAPVLVIYRNSNRPSGIPERFSGSNSGNTATLTISRAQAGDEADYYCQVWDSSTVVFGGGTELTVL

SEQ ID NO: 999 - protein, 128 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKNRYYYGMDVWGQGTTVTVSS

SEQ ID NO: 1000 - protein, 106 aa, Artificial Sequence; identical to SEQ ID NO: 960
  Synthetic Peptide

SEQ ID NO: 1001 - protein, 128 aa, Artificial Sequence
  Synthetic Peptide
QVQLVESGGDLVQPGRSLRLSCAASGFTFSNNGMHWVRQAPGKGLEWVAVISNDGSNKYYADSVRGRFTISRDNSKNTLYLQMNSLRAEDTAVYYCAKVYYGSGIYYKNRYYYGMDVWGQGTTVTVSS

SEQ ID NO: 1002 - protein, 106 aa, Artificial Sequence
  Synthetic Peptide
SYELTQPLSVSVALGQTARITCGGNNIGSKNVHWYQQKPGQAPVLVIYRNSNRPSGIPERFSGSNSGNTATLTLSRVQAGDEADYYCQVWDSSTVVFGGGTKLTVL

SEQ ID NO: 1003 - protein, 128 aa, Artificial Sequence
  Synthetic Peptide
QVQLVESGGGVVQPGRSLRLSCAVSGFNFSNNGMHWVRQAPGKGLEWVAVISNDGSNKYYADSVRGRFTISRDNSKNTLYLQMDSLRTEDTAVYYCAKVYYGSGIYYKNRYYYGMDVWGQGTTVTVSS

SEQ ID NO: 1004 - protein, 106 aa, Artificial Sequence
  Synthetic Peptide
SYELTQPPSVSVALGQTARLTCEGNNIGSKNVHWYQQKPGQAPVLVIYRDSNRPSGIPERFSGSKSGNTATLAISRAQAGDESDYYCQVWDSSAVVFGGGTKLTVL

SEQ ID NO: 1005 - protein, 128 aa, Artificial Sequence
  Synthetic Peptide
QVQLVESGGGVVQPGRSLRLSCAASGFTFSSSGMHWVRQAPGKGLEWVAVISNDGSNKYYADSVKGRFTISRDNSKNTLYLQMNSLRAEDTAVYYCAKVYYGSGIYYKNNYYYGMDVWGQGTTVTVSS

SEQ ID NO: 1006 - protein, 106 aa, Artificial Sequence
  Synthetic Peptide
SYELTQPPSVSVALGQTARITCGGNNIGSKNVHWYQQKPGQAPVLAIYRNSNRPSGIPERFTGSNSGNTATLTISGTQAMDEADYYCQAWDSSTVVFGGGTKLTVL

SEQ ID NO: 1007 - protein, 128 aa, Artificial Sequence; identical to SEQ ID NO: 955
  Synthetic Peptide

SEQ ID NO: 1008 - protein, 106 aa, Artificial Sequence
  Synthetic Peptide
SYELTQPPSVSVALGQTARITCGGNNIGSQNVHWYQQKPGQAPVLVIYRDSNRPSGIPERFSGSKSGNTATLAISRAQAGDESDYYCQVWDSSAVVFGGGTQLTVL

SEQ ID NO: 1009 - protein, 128 aa, Artificial Sequence
  Synthetic Peptide
QVQLVESGGGVVQPGRSLRLSCAASGFTLSSSGMHWVRQAPGKGLEWVAVISNDGSNKYYADSVKGRFTISRDDSKNTLYLQMDSLRTEDTAVYYCAKVYYGSGIYYKNRYYYGMDVWGQGTTVTVSS

SEQ ID NO: 1010 - protein, 106 aa, Artificial Sequence
  Synthetic Peptide
SYELTQPPSVSVALGQTARISCGGNNIGSKNVHWYQQKPGQAPVLVMYRDSNRPSGIPERFSGSNSGNTATLTISGTQAMDEADYYCQAWDSGTVVFGGGTKLTVL

SEQ ID NO: 1011 - protein, 128 aa, Artificial Sequence; identical to SEQ ID NO: 955
  Synthetic Peptide

SEQ ID NO: 1012 - protein, 106 aa, Artificial Sequence
  Synthetic Peptide
SYELTQPPSVSVALGQTARITCGGNNIGGKNVHWYQQKPGQAPVLVIYRDSNRPSGIPERFSGSKSGNTATLTISRAQAGDESDYYCQVWDSSTVVFGGGTQLTVL

SEQ ID NO: 1013 - protein, 128 aa, Artificial Sequence; identical to SEQ ID NO: 973
  Synthetic Peptide

SEQ ID NO: 1014 - protein, 106 aa, Artificial Sequence
  Synthetic Peptide
SYELTQPLSVSVALGQTARITCGGNNIGSKNVHWYQQKPGQAPVLVIYRNSNRPSGIPERFSGSNSGNTATLTISRAQAGDEADYYCQVWDSSTVVFGGGTKLTVL

SEQ ID NO: 1015 - protein, 128 aa, Artificial Sequence
  Synthetic Peptide
QVQLVESGGGLVKPGGSLRLSCAASGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSS

SEQ ID NO: 1016 - protein, 106 aa, Artificial Sequence
  Synthetic Peptide
SYELTQPPSVSVALGQTARISCGGNNIESKNVHWYQQKPGQAPVLVIYRDSNRPSGIPERFSGSKSGTTATLTISRAQAGDEAEYYCQVWDSSTVVFGGGTQLTVL

SEQ ID NO: 1017 - protein, 115 aa, Artificial Sequence; identical to SEQ ID NO: 13
  Synthetic Peptide

SEQ ID NO: 1018 - protein, 114 aa, Artificial Sequence
  Synthetic Peptide
DIVMTQSPDSLAVSLGERATINCKSSQSVLYSSNNRNYLAWYHQKPGQSPKLLISWASTRESGVPDRFSGSGSGTDFTLTINSLQAEDVAVYYCQQYYSIPITFGGGTKVEIKR

SEQ ID NO: 1019 - protein, 128 aa, Artificial Sequence
  Synthetic Peptide
QVQLVESGGGVVQPGRSLRLSCAASGFTFSNYGFHWVRQTPGKGLEWVAVISYDGSNRYYASSVKGRFTISRDNSKNTLYLQMNSLRGEDTALYYCARVYYGSGTYYKNRYYYGMDVWGQGTTVTVSS

SEQ ID NO: 1020 - protein, 107 aa, Artificial Sequence
  Synthetic Peptide
SYELTQPPSVSVALGQTARITCGGHNIGSKGVHWYQQKPGQAPVLVIYRAANRPSGIPERFSGSNSGNTATLTISGTQAGDEADYYCQAFDAGTVVFGGGTQLTVLG

SEQ ID NO: 1021 - protein, 128 aa, Artificial Sequence
  Synthetic Peptide
QVQLVESGGGVVQPGRSLRLSCAASGFTFSNYGFHWVRQTPGKGLEWVAVISYAGSNRYYAASVKGRFTISRDNSKNTLYLQMNSLRGEDTALYYCARVYYGSGTYYKNRYYYGMDVWGQGTTVTVSS

SEQ ID NO: 1022 - protein, 107 aa, Artificial Sequence
  Synthetic Peptide
SYELTQPPSVSVALGQTARITCGGHNIGSKGVHWYQQKPGQAPVLVIYRQSNRPSGIPERFSGSNSGNTATLTISGTQAEDEADYYCQAFDAGTVVFGGGTQLTVLG

SEQ ID NO: 1023 - protein, 128 aa, Artificial Sequence
  Synthetic Peptide
QVQLVESGGGVVQPGRSLRLSCAASGFTFSNYGFHWVRQTPGKGLEWVAVISYSGSNRYYADSVKGRFTISRDNSKNTLYLQMNSLRGEDTALYYCARVYYGSGTYYKNRYYYGMDVWGQGTTVTVSS

SEQ ID NO: 1024 - protein, 107 aa, Artificial Sequence
  Synthetic Peptide
SYELTQPPSVSVALGQTARITCGGHNIGSKGVHWYQQKPGQAPVLVIYRQSNRPSGIPERFSGSNSGNTATLTISGTQAGDEADYYCQAFDAGTVVFGGGTQLTVLG

SEQ ID NO: 1025 - protein, 107 aa, Artificial Sequence
  Synthetic Peptide
SYELTQPLSVSVALGQTARITCGGHNIGSKGVHWYQQKPGQAPVLVIYRNSNRPSGIPERFSGSNSGNTATLTISRAQAGDEADYYCQVWDISTVVFGGGTELTVLG

SEQ ID NO: 1026 - protein, 128 aa, Artificial Sequence
  Synthetic Peptide
QVQLVESGGGVAQPGRSLRLSCAASGFNFSNCGMHWVRQAPGKGLEWVAVISYDGGNKYHADSVKGRFTISRDDSKNTLYLQMDSLRTEDTAVYYCAKVYYGSGIYYKNRYYYGMDVWGQGTTVTVSS

SEQ ID NO: 1027 - protein, 107 aa, Artificial Sequence
  Synthetic Peptide
SYELTQPLSVSVALGQTARITCGGHNIGSKGVHWYQQKPGQAPVLVIYRNSNRPSGIPERFSGSNSGKTATLTISRAQAGDEADYYCQVWDSSTVVFGGGTELTVLG

SEQ ID NO: 1028 - protein, 128 aa, Artificial Sequence
  Synthetic Peptide
QVQLVESGGGVAQPGRSLRLSCAASGFNFSNCGMHWVRQAPGKGLEWVAVISYDGGNKYYADSVKGRFTISRDDSKNTLYLQMDSLRTEDTAVYYCAKVYYGSGIYYKNRYYYGMDVWGQGTTVTVSS

SEQ ID NO: 1029 - protein, 107 aa, Artificial Sequence
  Synthetic Peptide
SYELTQPLSVSVALGQTARITCGGNNIGSKNVHWYQKRPGQAPVLVIYRDSNRPSGIPERFSGSKSGNTATLTISRAQAGDEADYYCQVWDSNTVVFGGGTNLTVLG

SEQ ID NO: 1030 - protein, 128 aa, Artificial Sequence
  Synthetic Peptide
QVQLVESGGGVVQPGRSLRLSCVVSGFNFSNNGMHWVRQAPGKGLEWVAVISNDGSNKYYADSVRGRFTISRDNSKNTLYLQMNSLRAEDTAVYSCAKVYYGSGIYYKNNYYYGMDVWGQGTTVTVSS

SEQ ID NO: 1031 - protein, 107 aa, Artificial Sequence
  Synthetic Peptide
SYELTQPLSVSVALGQTARITCGGNNIGSKNVHWYQQKAGQAPVQVIYRNSNRPSGIPERFSGSNSGNTATLTISRAQAGDEADYYCQVWDSSTVVFGGGTKLTVLG

SEQ ID NO: 1032 - protein, 128 aa, Artificial Sequence
  Synthetic Peptide
QVQLVESGGGVVQPGRSLRLSCAASGFNFNTYGMHWVRQAPGKGLEWVAVISYDGSNKYYADSVKGRFTISRDNSKSTLYLQMNSLRAEDTAVYYCARVYYGSGSYYKKNYYYGMDVWGQGTTVTVSS

SEQ ID NO: 1033 - protein, 107 aa, Artificial Sequence
  Synthetic Peptide
SYELTQPLSVSVALGQTARITCGGNNIGGKNVHWYQQKPGQAPVLVIYRDSNRPSGIPERFSGSKSGNTATLTISRAQAGDESDYYCQVWDSSTVVFGGGTTLTVLG

SEQ ID NO: 1034 - protein, 128 aa, Artificial Sequence
  Synthetic Peptide
QVQVVESGGGVVQPGRSLRLSCAASGFTLSSYGFHWVRQTPGKGLEWVAVISYDGSNKYYADSVKGRFTISRDNSKNTLYLQMNSLRGEDTAVYYCARVYYGSGTYYKNRYYYGMDVWGQGTTVTVSS

SEQ ID NO: 1035 - protein, 107 aa, Artificial Sequence
  Synthetic Peptide
SYELTQPLSVSEALGQTARITCGGNNIGSKNVHWYQQKPGQAPVLVIYRDSNRPSGIPERFSGSKSGNTATLTISRAQAGDEADYYCQVWDSSTVVFGGGTKVTVLG

SEQ ID NO: 1036 - protein, 128 aa, Artificial Sequence
  Synthetic Peptide
QVQLVESGGGVVQPGRSLRLSCVVSGFNFINNGMHWVRQAPGKGLDWVAVISNDGSNKYYPDSVKGRFTISRDNSKNTLYLQMNSLRAEDSAVYYCAKVYYGSGNYYKNNYYYGMDVWGQGTTVTVSS

SEQ ID NO: 1037 - protein, 107 aa, Artificial Sequence
  Synthetic Peptide
SYELTQPLSVSVALGQTARITCEGNNIGSQNVHWYQQKPGQAPVLVMYRDSNRPSGIPERFSGSKSGNTATLAISRAQAGDESDYYCQVWDGSAVVFGGGTTLTVLG

SEQ ID NO: 1038 - protein, 128 aa, Artificial Sequence
  Synthetic Peptide
QMQVVESGGGVVQPGRSLRLSCAASGFTFSSSGMHWVRQAPGKGLEWVAVISHDGSNKYYADSVKGRFTISRDNSKNTLYLQMNSLGGEDTAVYYCAKVYYGSGIYYKNRYYYGMDVWGQGTTVIVSS

SEQ ID NO: 1039 - protein, 107 aa, Artificial Sequence
  Synthetic Peptide
SYELTQPLSVSVALGQTARITCGGHNIGSKGVHWYQQKPGQAPVLVIYRNSNRPSGIPERFSGSNSGNTATLTISRAQAGDEADYYCQVWDSSTVVFGGGTELTVLG

SEQ ID NO: 1040 - protein, 128 aa, Artificial Sequence
  Synthetic Peptide
QVQLVESGGGVAQPGRSLRLSCAASGFNFSDCGMHWVRQAPGKGLEWVAVISYDGGNKYYADSVKGRFTISRDDSKNTLYLQTDSLRTEDTAVYYCAKVYYGSGIYYKNRYYYGMDVWGQGTTVTVSS

SEQ ID NO: 1041 - protein, 107 aa, Artificial Sequence
  Synthetic Peptide
SYELTQPLSVSVALGQTGRITCGGNNIGSKNVHWYQQKPGQAPVLVIYRSSNRPSGIPERFSGSNSGNTATLTISRAQAGDESDYYCQIWDSSTVVFGGGTKLTVLG

SEQ ID NO: 1042 - protein, 128 aa, Artificial Sequence
  Synthetic Peptide
QVQVVESGGGVVQPGRSLRLSCAASGFTFSSYGMHWVRQAPGKGLEWVAVISFDGNNKYYADSVKGRFTISRDNSKNTLYLQMNSLRGEDTAVYYCARVYYGSGSYYKNRYYYGMDVWGQGTTVTVST

SEQ ID NO: 1043 - protein, 107 aa, Artificial Sequence
  Synthetic Peptide
SYELTQPLSVSVALGQTARITCGGNNIGSKNVHWYQQRPGQAPVLVIYRDSNRPSGIPERLSGSKAGNTATLTISRAHAGDEADYYCQVWDSSTVVFGGGTELTVQG

SEQ ID NO: 1044 - protein, 128 aa, Artificial Sequence
  Synthetic Peptide
QVQLVESGGGVVQPGRSLRLSCAVSGFTFSSNGMHWVRQAPGKGLEWVAVISNDGSNKYYGDSVKGRFTISRDNSKNTLYLQMNSLRAEDTAVYYCAKVYYGSGIYYRNNYYYGMDVWGQGTTVTVSS

SEQ ID NO: 1045 - protein, 107 aa, Artificial Sequence
  Synthetic Peptide
SYELTQPLSVSVALGQTARITCGGNNIGSKNVHWYQQKPGQAPILVIYRNTNRPSGIPERFSGSNSGNTATLTISRAQVGDESDYFCQVWDSSTVVFGGGTKLTVLG

SEQ ID NO: 1046 - protein, 128 aa, Artificial Sequence
  Synthetic Peptide
QVQVVESGGGVVQPGRSLRLSCGASGFTFSGYGMHWVRQAPGKGLEWVAVISYDGSNKYYADSVKGRFPISRDNSKNTLYLQMNSLRGEDTAVYYCARVYYGSGIYYKNRYYYGMDVWGQGTTVAVSS

SEQ ID NO: 1047 - protein, 107 aa, Artificial Sequence; identical to SEQ ID NO: 1045
  Synthetic Peptide

SEQ ID NO: 1048 - protein, 128 aa, Artificial Sequence
  Synthetic Peptide
QVQVVESGGGVVQPGRSLRLSCGASGFTFSGYGMHWVRQAPGKGLEWVAVISYDGSNKYYADSVKGRFTISRDNSKNTLYLQMNSLRGEDTAVYYCARVYYGSGIYYKNRYYYGMDVWGQGTTVAVSS

SEQ ID NO: 1049 - protein, 107 aa, Artificial Sequence
  Synthetic Peptide
SYDLTQPLSVSVALGQTARITCGGNNIGDKNVHWYQQKPGQAPVLVIYRNNVRPSGIPERFSGSNSGNTATLTISRAQAGDEADYYCQVWDSSTVVFGGGTKLTVLG

SEQ ID NO: 1050 - protein, 128 aa, Artificial Sequence
  Synthetic Peptide
QVQLVESGGGVVQPGRSLRLSCAASGLNFSNFGMHWVRQAPGKGLDWVAVISYDGGNKYYADSVKGRFTVSRDNSKNTLFLQMNSLRAEDTALYYCAKVYYGSGSYYKKRYYYGMDVWGQGTTVTVSS

SEQ ID NO: 1051 - protein, 107 aa, Artificial Sequence
  Synthetic Peptide
SYELTQPLSVSVALGQTARITCGGNNIGSKNVHWYQQKPGQAPVLVIYRDSNRPSGIPERFSGSKSGNTATLTISRAQAGDEADYYCQVWDSSTVVFGGGAKLTVLG

SEQ ID NO: 1052 - protein, 128 aa, Artificial Sequence
  Synthetic Peptide
QVQLVESGGGVVQPGRSLRLSCAASGFNFSSCGMHWVRQAPGKGLEWVAVISYDGTNKYYADSVKGRFTISRDNSKNTLYLQMNSLRAEDTAVYYCAKVYYGSGIYYKKNYYYGMDVWGQGTTVTVSS

SEQ ID NO: 1053 - protein, 115 aa, Artificial Sequence; identical to SEQ ID NO: 13
  Synthetic Peptide

SEQ ID NO: 1054 - protein, 114 aa, Artificial Sequence; identical to SEQ ID NO: 14
  Synthetic Peptide

SEQ ID NO: 1055 - protein, 330 aa, Artificial Sequence
  Synthetic Peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1056 - protein, 106 aa, Artificial Sequence
  Synthetic Peptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1057 - protein, 330 aa, Artificial Sequence; identical to SEQ ID NO: 1055
  Synthetic Peptide

SEQ ID NO: 1058 - protein, 105 aa, Artificial Sequence
  Synthetic Peptide
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1059 - protein, 330 aa, Artificial Sequence; identical to SEQ ID NO: 1055
  Synthetic Peptide

SEQ ID NO: 1060 - protein, 105 aa, Artificial Sequence; identical to SEQ ID NO: 1058
  Synthetic Peptide

SEQ ID NO: 1061 - protein, 330 aa, Artificial Sequence; identical to SEQ ID NO: 1055
  Synthetic Peptide

SEQ ID NO: 1062 - protein, 105 aa, Artificial Sequence; identical to SEQ ID NO: 1058
  Synthetic Peptide

SEQ ID NO: 1063 - protein, 105 aa, Artificial Sequence; identical to SEQ ID NO: 1058
  Synthetic Peptide

SEQ ID NO: 1064 - protein, 330 aa, Artificial Sequence; identical to SEQ ID NO: 1055
  Synthetic Peptide

SEQ ID NO: 1065 - protein, 105 aa, Artificial Sequence; identical to SEQ ID NO: 1058
  Synthetic Peptide

SEQ ID NO: 1066 - protein, 330 aa, Artificial Sequence; identical to SEQ ID NO: 1055
  Synthetic Peptide

SEQ ID NO: 1067 - protein, 105 aa, Artificial Sequence; identical to SEQ ID NO: 1058
  Synthetic Peptide

SEQ ID NO: 1068 - protein, 330 aa, Artificial Sequence; identical to SEQ ID NO: 1055
  Synthetic Peptide

SEQ ID NO: 1069 - protein, 105 aa, Artificial Sequence; identical to SEQ ID NO: 1058
  Synthetic Peptide

SEQ ID NO: 1070 - protein, 330 aa, Artificial Sequence; identical to SEQ ID NO: 1055
  Synthetic Peptide

SEQ ID NO: 1071 - protein, 105 aa, Artificial Sequence; identical to SEQ ID NO: 1058
  Synthetic Peptide

SEQ ID NO: 1072 - protein, 330 aa, Artificial Sequence; identical to SEQ ID NO: 1055
  Synthetic Peptide

SEQ ID NO: 1073 - protein, 105 aa, Artificial Sequence; identical to SEQ ID NO: 1058
  Synthetic Peptide

SEQ ID NO: 1074 - protein, 330 aa, Artificial Sequence; identical to SEQ ID NO: 1055
  Synthetic Peptide

SEQ ID NO: 1075 - protein, 105 aa, Artificial Sequence; identical to SEQ ID NO: 1058
  Synthetic Peptide

SEQ ID NO: 1076 - protein, 330 aa, Artificial Sequence; identical to SEQ ID NO: 1055
  Synthetic Peptide

SEQ ID NO: 1077 - protein, 105 aa, Artificial Sequence; identical to SEQ ID NO: 1058
  Synthetic Peptide

SEQ ID NO: 1078 - protein, 330 aa, Artificial Sequence; identical to SEQ ID NO: 1055
  Synthetic Peptide

SEQ ID NO: 1079 - protein, 105 aa, Artificial Sequence; identical to SEQ ID NO: 1058
  Synthetic Peptide

SEQ ID NO: 1080 - protein, 330 aa, Artificial Sequence; identical to SEQ ID NO: 1055
  Synthetic Peptide

SEQ ID NO: 1081 - protein, 105 aa, Artificial Sequence; identical to SEQ ID NO: 1058
  Synthetic Peptide

SEQ ID NO: 1082 - protein, 330 aa, Artificial Sequence; identical to SEQ ID NO: 1055
  Synthetic Peptide

SEQ ID NO: 1083 - protein, 105 aa, Artificial Sequence; identical to SEQ ID NO: 1058
  Synthetic Peptide

SEQ ID NO: 1084 - protein, 330 aa, Artificial Sequence; identical to SEQ ID NO: 1055
  Synthetic Peptide

SEQ ID NO: 1085 - protein, 105 aa, Artificial Sequence; identical to SEQ ID NO: 1058
  Synthetic Peptide

SEQ ID NO: 1086 - protein, 330 aa, Artificial Sequence; identical to SEQ ID NO: 1055
  Synthetic Peptide

SEQ ID NO: 1087 - protein, 105 aa, Artificial Sequence; identical to SEQ ID NO: 1058
  Synthetic Peptide

SEQ ID NO: 1088 - protein, 330 aa, Artificial Sequence; identical to SEQ ID NO: 1055
  Synthetic Peptide

SEQ ID NO: 1089 - protein, 105 aa, Artificial Sequence; identical to SEQ ID NO: 1058
  Synthetic Peptide

SEQ ID NO: 1090 - protein, 330 aa, Artificial Sequence; identical to SEQ ID NO: 1055
  Synthetic Peptide

SEQ ID NO: 1091 - protein, 330 aa, Artificial Sequence; identical to SEQ ID NO: 1055
  Synthetic Peptide

SEQ ID NO: 1092 - protein, 106 aa, Artificial Sequence; identical to SEQ ID NO: 1056
  Synthetic Peptide

SEQ ID NO: 1093 - protein, 249 aa, Artificial Sequence
  Synthetic Peptide
QVQLVESGGGVVQPGRSLRLSCVVSGFNFSNNGMHWVRQAPGKGLEWVAVISNDGSNKYYADSVKGRFTISRDNSKNTLYLQMNSLRTEDTAVYYCAKVYYGSGIYYKNRNYYGMDVWGQGTTVTVSSGGGGSGGGGSGGGGSSYELTQPPSVSVALGQTARITCGGNNIGSQNVHWYQQKPGQAPVLVIYRDSNRPSGIPDRFSGSKSGNTATLTISRAQAGDEADYYCQVWDSSTVVFGGGTKLTVL

SEQ ID NO: 1094 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPPSVSVALGQTARITCGGHNIGSKGVHWYQQKPGQAPVLVIYRNSNRPSGIPERFSGSNSGNTATLTITRAQAGDEADYYCQVWDSSTVVFGGGTKLTVL

SEQ ID NO: 1095 - protein, 249 aa, Artificial Sequence
  Synthetic Peptide
QVQLVESGGGVVQPGRSLRLSCAPSGFNFSNYGMHWVRQAPGKGLEWVAVISYDGSNKYYADSVKGRFTISRDNSKNTLFLQMNSLRAEDTAVYFCARVYYGSGSYYKKRYYYGMDVWGQGTTVTVSSGGGGSGGGGSGGGGSSYELTQPPSVSVALGQTARITCGGNNIGSQNVHWYQQKPGQAPVLVIYRDSNRPSGIPERFSGSKSGNTATLTISRAQAGDEADYYCQVWDSSTVVFGGGTQLTVL

SEQ ID NO: 1096 - protein, 249 aa, Artificial Sequence
  Synthetic Peptide
QVQLVESGGGVVQPGRSLRLSCAASGFTFSSSGMHWVRQAPGKGLEWVAVISYDGTNKYYADSVKGRFTISRDNSKNTLYLQMNSLRAEDTAVYYCAKVYYGSGIYYKNRYYYGMDVWGQGTTVTVSSGGGGSGGGGSGGGGSSYELTQPPSVSVALGQTARITCGGHNIGSKGVHWYQQKPGQAPVLVIYRNSNRPSGIPERFSGSNSGNTATLTISRAQAGDEADYYCQVWDSSTVVFGGGTQLTVL

SEQ ID NO: 1097 - protein, 249 aa, Artificial Sequence
  Synthetic Peptide
QVQLVESGGGVVQPGRSLRLSCAVSGFNFSNYGMHWVRQVPGRGLDWVAVISNDGSNKYYADSVKGRFTISRDNSKNTLYLQMDSLRTEDTAVYYCAKVYYGSGIYYKKRYYYGMDVWGQGTTVTVSSGGGGSGGGGSGGGGSSYELTQPPSVSVALGQTARITCGGHNIGSQNVHWYQQKPGQAPVLVIYRDSNRPSGIPERFSGSKSGNTATLTISRAQAGDEADYYCQVWDSSTVVFGGGTQLTVL

SEQ ID NO: 1098 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPPSVSVAPGQTARITCGGNNIGSKNVHWYQQKAGQAPVQVIYRNSNRPSGIPARFSGSNSGNTATLTISRAQAGDEADYYCQVWDSSTVVFGGGTKLTVL

SEQ ID NO: 1099 - protein, 248 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRGEDTAVYYCARVYYGSGSYYKNRYYYGMDVWGQGTTVTVSSGGGGSGGGGSGGGGSSYELTQPPSVSVAPGQTARIPCGGNNIGSKNVHWYQQKPGQAPVLVIYRDINRPSGIPERFSGSNSGNTATLTISRAQAGDEADYYCQVWDSSVVFGGGTKLTVL

SEQ ID NO: 1100 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPPSVSVALGQTARLTCEGNNIGSKNVHWYQQKPGQAPVLVIYRNSNRPSGIPERFSGSNSGNTATLTISRVQAGDEADYYCQAWDSSTVVFGGGTQLTVL

SEQ ID NO: 1101 - protein, 251 aa, Artificial Sequence
  Synthetic Peptide
QVQLVESGGGLVKPGGSLRLSCAVSGFNFSNNGMHWVRQAPGKGLEWVAVISYDGSNKYYTDSVKGRFTISRDNSKNTLYLQMNSLRTEDTAVYYCAKVYYGSGIYYKKRYYYGMDVWGQGTTVTVSSGGGGSGGGGSGGGGSSYELTQPLSVSEALGQTARITCGGNNIGSKNVHWYQQKPGQAPVLVIYRDSNRPSGIPERFSGSNSGNAATLTISRVEAGDEADYYCQVWDSSSDHVVFGGGTQLTVL

SEQ ID NO: 1102 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPPSVSVAPGQTARITCGGNNIGSKNVHWYQQKPGQAPVLVIYRNSNRPSGIPERFSGSNSGNTATLTISGTQAMDEADYYCQAWDSSNVVFGGGTQLTVL

SEQ ID NO: 1103 - protein, 249 aa, Artificial Sequence
  Synthetic Peptide
QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSSGGGGSGGGGSGGGGSSYELTQPLSVSVALGQTARITCGGNNIGSQNVHWYQQKPGQAPVLVIYRDSNRPSGIPDRFSGSKSGNTATLTISRAQAGDEADYYCQVWDSSTVVFGGGTQLTVL

SEQ ID NO: 1104 - protein, 249 aa, Artificial Sequence
  Synthetic Peptide
QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNRYYYGMDVWGQGTTVTVSSGGGGSGGGGSGGGGSSYELTQPPSVSVAPGQTARITCGGNNIGSKNVHWYQQKPGQAPVLVIYRDSNRPSGIPERFSGSKSGTTATLTISRAQAGDEAEYYCQVWDSSTVVFGGGTELTVL

SEQ ID NO: 1105 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPLSVSVALGQTARITCGGNNIGSKNVHWYQQKPGQAPVLAIYRNSNRPSGIPERFTGSNSGNTATLTISRAQAGDESDYYCQIWDSSTVVFGGGTKLTVL

SEQ ID NO: 1106 - protein, 249 aa, Artificial Sequence
  Synthetic Peptide
QVQLVESGGGVVQPGRSLRLSCAASGFNFSRNGMHWVRQVPGRGLDWVAVISNDGSNKYYADSVKGRFTISRDNSKNTLYLQMNSLRAEDTAVYYCAKVYYGSGIYYKKNYYYGMDVWGQGTTVTVSSGGGGSGGGGSGGGGSSYELTQPPSVSVALGQTARISCGGNNIGSKNVHWYQQKPGQAPVLVIYRDSNRPSGIPERFSGSKSGTTATLTISRAQAGDEAEYYCQVWDSSTVVFGGGTQLTVL

SEQ ID NO: 1107 - protein, 249 aa, Artificial Sequence
  Synthetic Peptide
QVQLVESGGGVVQPGRSLRLSCAVSGFNFSNNGMHWVRQAPGKGLEWVAVISYDGSNKYYTDSVKGRFTISRDNSKNTLYLQMNSLRTEDTAVYYCAKVYYGSGIYYKKRYYYGMDVWGQGTTVTVSSGGGGSGGGGSGGGGSSYELTQPPSVSVALGQTARITCEGNNIGSQNVHWYQQKPGQAPVLVMYRDSNRPSGIPERFSGSKSGNTATLAISRAQAGDESDYYCQVWDGSAVVFGGGTKLTVL

SEQ ID NO: 1108 - protein, 249 aa, Artificial Sequence
  Synthetic Peptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPLSVSVALGQTARITCEGNNIGSQNVHWYQQKPGQAPVLVMYRDSNRPSGIPERFSGSKSGNTATLAISRAQAGDESDYYCQVWDGSAVVFGGGTQLTVL

SEQ ID NO: 1109 - protein, 249 aa, Artificial Sequence
  Synthetic Peptide
QVQLVESGGGVVQPGRSLRLSCAASGFTFSNYGFHWVRQTPGKGLEWVAVISYDGSNRYYADSVKGRFTISRDNSKNTLYLQMNSLRGEDTALYYCARVYYGSGTYYKNRYYYGMDVWGQGTTVTVSSGGGGSGGGGSGGGGSSYELTQPPSVSVALGQTARITCGGHNIGSKGVHWYQQKPGQAPVLVIYRNSNRPSGIPERFSGSNSGNTATLTISGTQAMDEADYYCQAWDSGTVVFGGGTQLTVL

SEQ ID NO: 1110 - protein, 251 aa, Artificial Sequence
  Synthetic Peptide
QVQLVESGGGVVQPGRSLRLSCAASGFTFSNYGFHWVRQTPGKGLEWVAVISYDGSNRYYADSVKGRFTISRDNSKNTLYLQMNSLRGEDTALYYCARVYYGSGTYYKNRYYYGMDVWGQGTTVTVSSGGGGSGGGGSGGGGSSYELTQPPSVSVALGQTARITCGANNIGSKNVHWYQQKPGQPPVLVIYRDFNRPSGIPERFSASNSGNTATLTISRGQAGDEADYYCQVWDSSTGNVVFGGGTKLTVL

SEQ ID NO: 1111 - protein, 249 aa, Artificial Sequence
  Synthetic Peptide
QVQLVESGGGVVQPGRSLRLSCAASGFIFSNYGFHWVRQTPGKGLEWVAVISYDGSNKYYADSVKGRFTISRDNSKNTLYLQMNSLRGEDTAVYYCARVYYGSGSYYKNRYYYGMDVWGQGTTVTVSSGGGGSGGGGSGGGGSSYELTQPPSVSVAPGQTARITCGGNNIGSKNVHWYQQKPGQAPVLVIYRDSNRPSGIPERFSGSKSGTTATLTISRAQAGDEADYYCQVWDSSTVVFGGGTELTVL

SEQ ID NO: 1112 - protein, 251 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQSSSVSVAPGQTARITCGGNNIGSKNVHWYQQKPGQAPVLVIYRDSNRPSGIPERFSGSKSGTTATLTISRVEAGDEADYYCQVWDSSSAHVIFGGGTKLTVL

SEQ ID NO: 1113 - protein, 249 aa, Artificial Sequence
  Synthetic Peptide
QVQLVESGGGVVQPGRSLRLSCGASGFTFSGYGMHWVRQAPGKGLEWVAVISYDGSNKYYADSVKGRFTISRDNSKNTLYLQMNSLRGEDTAVYYCARVYYGSGIYYKNRYYYGMDVWGQGTTVTVSSGGGGSGGGGSGGGGSSYELTQPPSGSVALGQTARITCGGNNLGSKNVHWYQQKPGQAPVLVIYRNSNRPSGIPERFSGSNSGNTATLTISRAQAGDEADYYCQVWDSSTVVFGGGTKLTVL

SEQ ID NO: 1114 - protein, 249 aa, Artificial Sequence
  Synthetic Peptide
QVQLVESGGGLVKPGGSLRLSCAASGFTFSNNGMHWVRQAPGKGLEWVAVISYDGSNKYYADSVKGRFTISRDNSKNTLYLQMNSLRAEDTAVYYCAKVYYGSGIYYKNRYYYGMDVWGQGTTVTVSSGGGGSGGGGSGGGGSSYELTQPPSVSVALGQTARITCGGNRIGSKNVHWYQQKPGQAPVLVIYRDSNRPSGIPERFSGSKSGTTATLTISRAQAGDEAEYYCQVWDSSTVVFGGGTKLTVL

SEQ ID NO: 1115 - protein, 249 aa, Artificial Sequence
  Synthetic Peptide
QVQLVESGGGVVQPGRSLRLSCAASGFTFSNYGFHWVRQTPGKGLEWVAVISYDGSNRYYADSVKGRFTISRDNSKNTLYLQMNSLRGEDTALYYCARVYYGSGTYYKNRYYYGMDVWGQGTTVTVSSGGGGSGGGGSGGGGSSYELTQLPSVSVALGQTARITCGGHNIGSKGVHWYQQKPGQAPVLVIYRNSNRPSGIPERFSGSNSGNTATLTISRAQAGDEADYYCQVWDSSTVVFGGGTELTVL

SEQ ID NO: 1116 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKNRYYYGMDVWGQGTTVTVSSGGGGSGGGGSGGGGSSYELTQPPSVSVALGQTARITCGGHNIGSKGVHWYQQKPGQAPVLVIYRNSNRPSGIPERFSGSNSGNTATLTISRAQAGDEADYYCQVWDSSTVVFGGGTQLTVL

SEQ ID NO: 1117 - protein, 249 aa, Artificial Sequence
  Synthetic Peptide
QVQLVESGGDLVQPGRSLRLSCAASGFTFSNNGMHWVRQAPGKGLEWVAVISNDGSNKYYADSVRGRFTISRDNSKNTLYLQMNSLRAEDTAVYYCAKVYYGSGIYYKNRYYYGMDVWGQGTTVTVSSGGGGSGGGGSGGGGSSYELTQPLSVSVALGQTARITCGGNNIGSKNVHWYQQKPGQAPVLVIYRNSNRPSGIPERFSGSNSGNTATLTLSRVQAGDEADYYCQVWDSSTVVFGGGTKLTVL

SEQ ID NO: 1118 - protein, 249 aa, Artificial Sequence
  Synthetic Peptide
QVQLVESGGGVVQPGRSLRLSCAVSGFNFSNNGMHWVRQAPGKGLEWVAVISNDGSNKYYADSVRGRFTISRDNSKNTLYLQMDSLRTEDTAVYYCAKVYYGSGIYYKNRYYYGMDVWGQGTTVTVSSGGGGSGGGGSGGGGSSYELTQPPSVSVALGQTARLTCEGNNIGSKNVHWYQQKPGQAPVLVIYRDSNRPSGIPERFSGSKSGNTATLAISRAQAGDESDYYCQVWDSSAVVFGGGTKLTVL

SEQ ID NO: 1119 - protein, 249 aa, Artificial Sequence
  Synthetic Peptide
QVQLVESGGGVVQPGRSLRLSCAASGFTFSSSGMHWVRQAPGKGLEWVAVISNDGSNKYYADSVKGRFTISRDNSKNTLYLQMNSLRAEDTAVYYCAKVYYGSGIYYKNNYYYGMDVWGQGTTVTVSSGGGGSGGGGSGGGGSSYELTQPPSVSVALGQTARITCGGNNIGSKNVHWYQQKPGQAPVLAIYRNSNRPSGIPERFTGSNSGNTATLTISGTQAMDEADYYCQAWDSSTVVFGGGTKLTVL

SEQ ID NO: 1120 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPPSVSVALGQTARITCGGNNIGSQNVHWYQQKPGQAPVLVIYRDSNRPSGIPERFSGSKSGNTATLAISRAQAGDESDYYCQVWDSSAVVFGGGTQLTVL

SEQ ID NO: 1121 - protein, 249 aa, Artificial Sequence
  Synthetic Peptide
QVQLVESGGGVVQPGRSLRLSCAASGFTLSSSGMHWVRQAPGKGLEWVAVISNDGSNKYYADSVKGRFTISRDDSKNTLYLQMDSLRTEDTAVYYCAKVYYGSGIYYKNRYYYGMDVWGQGTTVTVSSGGGGSGGGGSGGGGSSYELTQPPSVSVALGQTARISCGGNNIGSKNVHWYQQKPGQAPVLVMYRDSNRPSGIPERFSGSNSGNTATLTISGTQAMDEADYYCQAWDSGTVVFGGGTKLTVL

SEQ ID NO: 1122 - protein, 249 aa, Artificial Sequence
  Synthetic Peptide
QVQLVESGGGVVQPGRSLRLSCAASGFNFSNYGMHWVRQAPGKGLEWVAVISYDGSNKYYADSVKGRFTISRDNSKNTLYLQMNSLRAEDTAVYFCARVYYGSGIYYKKRYYYGMDVWGQGTTVTVSSGGGGSGGGGSGGGGSSYELTQPPSVSVALGQTARITCGGNNIGGKNVHWYQQKPGQAPVLVIYRDSNRPSGIPERFSGSKSGNTATLTISRAQAGDESDYYCQVWDSSTVVFGGGTQLTVL

SEQ ID NO: 1123 - protein, 249 aa, Artificial Sequence
  Synthetic Peptide
QVQLVESGGGVVQPGRSLRLSCVVSGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSSGGGGSGGGGSGGGGSSYELTQPLSVSVALGQTARITCGGNNIGSKNVHWYQQKPGQAPVLVIYRNSNRPSGIPERFSGSNSGNTATLTISRAQAGDEADYYCQVWDSSTVVFGGGTKLTVL

SEQ ID NO: 1124 - protein, 249 aa, Artificial Sequence
  Synthetic Peptide
QVQLVESGGGLVKPGGSLRLSCAASGFNFSRNGMHWVRQVPGRGLDWVAVISNDGSNKYYADSVKGRFTISRDNSKNTLYLQMNSLRAEDTAVYYCAKVYYGSGIYYKNNYYYGMDVWGQGTTVTVSSGGGGSGGGGSGGGGSSYELTQPPSVSVALGQTARISCGGNNIESKNVHWYQQKPGQAPVLVIYRDSNRPSGIPERFSGSKSGTTATLTISRAQAGDEAEYYCQVWDSSTVVFGGGTQLTVL

SEQ ID NO: 1125 - protein, 445 aa, Artificial Sequence; identical to SEQ ID NO: 354
  Synthetic Peptide

SEQ ID NO: 1126 - protein, 220 aa, Artificial Sequence
  Synthetic Peptide
DIVMTQSPDSLAVSLGERATINCKSSQSVLYSSNNRNYLAWYHQKPGQSPKLLISWASTRESGVPDRFSGSGSGTDFTLTINSLQAEDVAVYYCQQYYSIPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1127 - protein, 458 aa, Artificial Sequence
  Synthetic Peptide
QVQLVESGGGVVQPGRSLRLSCAASGFTFSNYGFHWVRQTPGKGLEWVAVISYDGSNRYYASSVKGRFTISRDNSKNTLYLQMNSLRGEDTALYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1128 - protein, 212 aa, Artificial Sequence
  Synthetic Peptide
SYELTQPPSVSVALGQTARITCGGHNIGSKGVHWYQQKPGQAPVLVIYRAANRPSGIPERFSGSNSGNTATLTISGTQAGDEADYYCQAFDAGTVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1129 - protein, 458 aa, Artificial Sequence
  Synthetic Peptide
QVQLVESGGGVVQPGRSLRLSCAASGFTFSNYGFHWVRQTPGKGLEWVAVISYAGSNRYYAASVKGRFTISRDNSKNTLYLQMNSLRGEDTALYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1130 - protein, 212 aa, Artificial Sequence
  Synthetic Peptide
SYELTQPPSVSVALGQTARITCGGHNIGSKGVHWYQQKPGQAPVLVIYRQSNRPSGIPERFSGSNSGNTATLTISGTQAEDEADYYCQAFDAGTVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1131 - protein, 458 aa, Artificial Sequence
  Synthetic Peptide
QVQLVESGGGVVQPGRSLRLSCAASGFTFSNYGFHWVRQTPGKGLEWVAVISYSGSNRYYADSVKGRFTISRDNSKNTLYLQMNSLRGEDTALYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1132 - protein, 212 aa, Artificial Sequence
  Synthetic Peptide
SYELTQPPSVSVALGQTARITCGGHNIGSKGVHWYQQKPGQAPVLVIYRQSNRPSGIPERFSGSNSGNTATLTISGTQAGDEADYYCQAFDAGTVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1133 - protein, 212 aa, Artificial Sequence
  Synthetic Peptide
SYELTQPLSVSVALGQTARITCGGHNIGSKGVHWYQQKPGQAPVLVIYRNSNRPSGIPERFSGSNSGNTATLTISRAQAGDEADYYCQVWDISTVVFGGGTELTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1134 - protein, 458 aa, Artificial Sequence
  Synthetic Peptide
QVQLVESGGGVAQPGRSLRLSCAASGFNFSNCGMHWVRQAPGKGLEWVAVISYDGGNKYHADSVKGRFTISRDDSKNTLYLQMDSLRTEDTAVYYCAKVYYGSGIYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1135 - protein, 212 aa, Artificial Sequence
  Synthetic Peptide
SYELTQPLSVSVALGQTARITCGGHNIGSKGVHWYQQKPGQAPVLVIYRNSNRPSGIPERFSGSNSGKTATLTISRAQAGDEADYYCQVWDSSTVVFGGGTELTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1136 - protein, 458 aa, Artificial Sequence
  Synthetic Peptide
QVQLVESGGGVAQPGRSLRLSCAASGFNFSNCGMHWVRQAPGKGLEWVAVISYDGGNKYYADSVKGRFTISRDDSKNTLYLQMDSLRTEDTAVYYCAKVYYGSGIYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1137 - protein, 212 aa, Artificial Sequence
  Synthetic Peptide
SYELTQPLSVSVALGQTARITCGGNNIGSKNVHWYQKRPGQAPVLVIYRDSNRPSGIPERFSGSKSGNTATLTISRAQAGDEADYYCQVWDSNTVVFGGGTNLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1138 - protein, 458 aa, Artificial Sequence
  Synthetic Peptide
QVQLVESGGGVVQPGRSLRLSCVVSGFNFSNNGMHWVRQAPGKGLEWVAVISNDGSNKYYADSVRGRFTISRDNSKNTLYLQMNSLRAEDTAVYSCAKVYYGSGIYYKNNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1139 - protein, 212 aa, Artificial Sequence
  Synthetic Peptide
SYELTQPLSVSVALGQTARITCGGNNIGSKNVHWYQQKAGQAPVQVIYRNSNRPSGIPERFSGSNSGNTATLTISRAQAGDEADYYCQVWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1140 - protein, 458 aa, Artificial Sequence
  Synthetic Peptide
QVQLVESGGGVVQPGRSLRLSCAASGFNFNTYGMHWVRQAPGKGLEWVAVISYDGSNKYYADSVKGRFTISRDNSKSTLYLQMNSLRAEDTAVYYCARVYYGSGSYYKKNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1141 - protein, 212 aa, Artificial Sequence
  Synthetic Peptide
SYELTQPLSVSVALGQTARITCGGNNIGGKNVHWYQQKPGQAPVLVIYRDSNRPSGIPERFSGSKSGNTATLTISRAQAGDESDYYCQVWDSSTVVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1142 - protein, 458 aa, Artificial Sequence
  Synthetic Peptide
QVQVVESGGGVVQPGRSLRLSCAASGFTLSSYGFHWVRQTPGKGLEWVAVISYDGSNKYYADSVKGRFTISRDNSKNTLYLQMNSLRGEDTAVYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1143 - protein, 212 aa, Artificial Sequence
  Synthetic Peptide
SYELTQPLSVSEALGQTARITCGGNNIGSKNVHWYQQKPGQAPVLVIYRDSNRPSGIPERFSGSKSGNTATLTISRAQAGDEADYYCQVWDSSTVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1144 - protein, 458 aa, Artificial Sequence
  Synthetic Peptide
QVQLVESGGGVVQPGRSLRLSCVVSGFNFINNGMHWVRQAPGKGLDWVAVISNDGSNKYYPDSVKGRFTISRDNSKNTLYLQMNSLRAEDSAVYYCAKVYYGSGNYYKNNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1145 - protein, 212 aa, Artificial Sequence
  Synthetic Peptide
SYELTQPLSVSVALGQTARITCEGNNIGSQNVHWYQQKPGQAPVLVMYRDSNRPSGIPERFSGSKSGNTATLAISRAQAGDESDYYCQVWDGSAVVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1146 - protein, 458 aa, Artificial Sequence
  Synthetic Peptide
QMQVVESGGGVVQPGRSLRLSCAASGFTFSSSGMHWVRQAPGKGLEWVAVISHDGSNKYYADSVKGRFTISRDNSKNTLYLQMNSLGGEDTAVYYCAKVYYGSGIYYKNRYYYGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1147 - protein, 212 aa, Artificial Sequence
  Synthetic Peptide
SYELTQPLSVSVALGQTARITCGGHNIGSKGVHWYQQKPGQAPVLVIYRNSNRPSGIPERFSGSNSGNTATLTISRAQAGDEADYYCQVWDSSTVVFGGGTELTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1148 - protein, 458 aa, Artificial Sequence
  Synthetic Peptide
QVQLVESGGGVAQPGRSLRLSCAASGFNFSDCGMHWVRQAPGKGLEWVAVISYDGGNKYYADSVKGRFTISRDDSKNTLYLQTDSLRTEDTAVYYCAKVYYGSGIYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1149 - protein, 212 aa, Artificial Sequence
  Synthetic Peptide
SYELTQPLSVSVALGQTGRITCGGNNIGSKNVHWYQQKPGQAPVLVIYRSSNRPSGIPERFSGSNSGNTATLTISRAQAGDESDYYCQIWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1150 - protein, 458 aa, Artificial Sequence
  Synthetic Peptide
QVQVVESGGGVVQPGRSLRLSCAASGFTFSSYGMHWVRQAPGKGLEWVAVISFDGNNKYYADSVKGRFTISRDNSKNTLYLQMNSLRGEDTAVYYCARVYYGSGSYYKNRYYYGMDVWGQGTTVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1151 - protein, 212 aa, Artificial Sequence
  Synthetic Peptide
SYELTQPLSVSVALGQTARITCGGNNIGSKNVHWYQQRPGQAPVLVIYRDSNRPSGIPERLSGSKAGNTATLTISRAHAGDEADYYCQVWDSSTVVFGGGTELTVQGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1152 - protein, 458 aa, Artificial Sequence
  Synthetic Peptide
QVQLVESGGGVVQPGRSLRLSCAVSGFTFSSNGMHWVRQAPGKGLEWVAVISNDGSNKYYGDSVKGRFTISRDNSKNTLYLQMNSLRAEDTAVYYCAKVYYGSGIYYRNNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1153 - protein, 212 aa, Artificial Sequence
  Synthetic Peptide
SYELTQPLSVSVALGQTARITCGGNNIGSKNVHWYQQKPGQAPILVIYRNTNRPSGIPERFSGSNSGNTATLTISRAQVGDESDYFCQVWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1154 - protein, 458 aa, Artificial Sequence
  Synthetic Peptide
QVQVVESGGGVVQPGRSLRLSCGASGFTFSGYGMHWVRQAPGKGLEWVAVISYDGSNKYYADSVKGRFPISRDNSKNTLYLQMNSLRGEDTAVYYCARVYYGSGIYYKNRYYYGMDVWGQGTTVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1155 - protein, 212 aa, Artificial Sequence; identical to SEQ ID NO: 1153
  Synthetic Peptide

SEQ ID NO: 1156 - protein, 458 aa, Artificial Sequence
  Synthetic Peptide
QVQVVESGGGVVQPGRSLRLSCGASGFTFSGYGMHWVRQAPGKGLEWVAVISYDGSNKYYADSVKGRFTISRDNSKNTLYLQMNSLRGEDTAVYYCARVYYGSGIYYKNRYYYGMDVWGQGTTVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1157 - protein, 212 aa, Artificial Sequence
  Synthetic Peptide
SYDLTQPLSVSVALGQTARITCGGNNIGDKNVHWYQQKPGQAPVLVIYRNNVRPSGIPERFSGSNSGNTATLTISRAQAGDEADYYCQVWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1158 - protein, 458 aa, Artificial Sequence
  Synthetic Peptide
QVQLVESGGGVVQPGRSLRLSCAASGLNFSNFGMHWVRQAPGKGLDWVAVISYDGGNKYYADSVKGRFTVSRDNSKNTLFLQMNSLRAEDTALYYCAKVYYGSGSYYKKRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1159 - protein, 212 aa, Artificial Sequence
  Synthetic Peptide
SYELTQPLSVSVALGQTARITCGGNNIGSKNVHWYQQKPGQAPVLVIYRDSNRPSGIPERFSGSKSGNTATLTISRAQAGDEADYYCQVWDSSTVVFGGGAKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1160 - protein, 458 aa, Artificial Sequence
  Synthetic Peptide
QVQLVESGGGVVQPGRSLRLSCAASGFNFSSCGMHWVRQAPGKGLEWVAVISYDGTNKYYADSVKGRFTISRDNSKNTLYLQMNSLRAEDTAVYYCAKVYYGSGIYYKKNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1161 - protein, 445 aa, Artificial Sequence; identical to SEQ ID NO: 354
  Synthetic Peptide

SEQ ID NO: 1162 - protein, 220 aa, Artificial Sequence; identical to SEQ ID NO: 16
  Synthetic Peptide

SEQ ID NO: 1163 - DNA, 747 bp, Artificial Sequence
  Synthetic Peptide
caggtgcagctggtggagtctgggggaggcgtggtccagcctgggaggtccctgagactctcctgtgtagtctctggattcaacttcagtaacaatggcatgcactgggtccgccaggctccaggcaagggactggagtgggtggcagttatttcaaatgatggaagtaataaatactatgcagactccgtgaagggccgattcaccatctccagagacaattccaagaacacgctgtatctacaaatgaacagcctgagaactgaggacacggctgtgtattactgtgcgaaagtttactatggttcgggtatttattataaaaacaggaactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggaaacaacattggaagtcaaaatgtgcactggtaccagcagaagccaggccaggcccctgtgctggtcatctatagggatagcaaccggccctctgggatccctgaccgattctctggctccaagtcggggaacacggccaccctgaccatcagcagagcccaagccggggatgaggctgactattactgtcaggtgtgggacagcagcactgtggttttcggcggagggaccaagctgaccgtccta

SEQ ID NO: 1164 - DNA, 747 bp, Artificial Sequence
  Synthetic Peptide
caggtgcagctggtggagtctgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggacacaacattggaagtaaaggtgtgcactggtaccagcagaagccaggccaggcccctgtgctggtcatctataggaatagcaaccggccctctgggatccctgagcgattctctggctccaactcggggaacacggccaccctgaccatcaccagagcccaagccggggatgaggctgactattactgtcaggtgtgggacagcagcactgtggttttcggcggagggaccaagctgaccgtccta

SEQ ID NO: 1165 - DNA, 747 bp, Artificial Sequence
  Synthetic Peptide
caggtgcagctggtggagtccgggggaggcgtggtccagcctgggaggtccctgagactctcctgtgcaccctctggattcaacttcagtaactatggcatgcactgggtccgccaggctccaggcaaggggctggagtgggtggcagttatatcatatgatggaagtaataaatattatgcagactccgtgaagggccgattcaccatctccagagacaattccaaaaacacgctgtttctgcaaatgaacagcctgagagctgaggacacggctgtgtatttctgtgcgagagtttactatggttcggggagttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggaaacaacattggaagtcaaaatgtgcactggtaccagcagaagccaggccaggcccctgtgctggtcatctatagggatagcaaccggccctctgggatccctgagcgattctctggctccaagtcggggaacacggccaccctgaccatcagcagagcccaagccggggatgaggctgactattactgtcaggtgtgggacagcagcactgtggttttcggcggaggcacccagctgaccgtccta

SEQ ID NO: 1166 - DNA, 747 bp, Artificial Sequence
  Synthetic Peptide
caggtgcagctggtggagtccgggggaggcgtggtccagcctgggaggtccctgagactctcctgtgcagcgtctggattcaccttcagtagctctggcatgcactgggtccgccaggctccaggcaaggggctggagtgggtggcagttatatcatatgatggaactaataaatactatgcggactccgtgaagggccgattcaccatctccagagacaattccaagaacacgctgtatctgcaaatgaacagcctgagagctgaggacacggctgtgtattactgtgcgaaagtttactatggttcgggtatttattataaaaacaggtactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggacacaacattggaagtaaaggtgtgcactggtaccagcagaagccaggccaggcccctgtgctggtcatctatagaaatagcaaccggccctctgggatccctgagcgattctctggctccaactcggggaacacggccaccctgaccatcagcagagcccaagccggggatgaggctgactattactgtcaggtgtgggacagcagcactgtggttttcggcggaggcacccagctgaccgtccta

SEQ ID NO: 1167 - DNA, 747 bp, Artificial Sequence
  Synthetic Peptide
caggtgcagctggtggagtctgggggaggcgtggtccagcctgggaggtccctgagactctcctgtgcagtctctggattcaacttcagtaactatggcatgcactgggtccgccaggttccaggcagggggctagattgggtggcagttatatcaaatgatggaagtaataaatactatgcagactccgtgaagggccgattcaccatttccagagacaattccaagaacacactgtatctgcaaatggacagcctgagaactgaggacacggctgtgtattactgtgcgaaagtttactatggttcgggtatttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggacacaacattggaagtcaaaatgtgcactggtaccagcagaagccaggccaggcccctgtgctggtcatctatagggatagcaaccggccctctgggatccctgagcgattctctggctccaagtcggggaacacggccaccctgaccatcagcagagcccaagccggggatgaggctgactattactgtcaggtgtgggacagcagcactgtggttttcggcggaggcacccagctgaccgtccta

SEQ ID NO: 1168 - DNA, 747 bp, Artificial Sequence
  Synthetic Peptide
caggtgcagctggtggagtccgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacgggatggacgtctggggccaagggaccacggtcaccgtctcctcaggtggtggtggttctggcggcggcggctccggtggtggtggttcttcatatgagctgactcagccaccctcggtgtcagtggccccaggacagacggccaggattacctgtgggggaaacaacattggaagtaaaaatgtgcactggtaccagcagaaggcaggccaggcccctgtgcaggtcatctatagaaatagcaaccggccctctgggatccctgcgcgattctctggctccaactcggggaacacggccaccctgaccatcagcagagcccaggccggggatgaggctgactattactgtcaggtgtgggacagcagcactgtggttttcggcggtgggaccaagctgaccgtccta

SEQ ID NO: 1169 - DNA, 744 bp, Artificial Sequence
  Synthetic Peptide
caggtgcagctggtggagtccgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagaggtgaggacacggcggtgtattactgtgcgagagtttactatggttcggggagttattataaaaaccgctactactacggtatggacgtctggggccaagggaccacggtcaccgtctcctcaggtggtggtggttctggcggcggcggctccggtggtggtggttcttcatatgagctgactcagccaccctcggtgtcagtggccccaggacagacggccaggattccctgtgggggaaacaacattggaagtaaaaatgtgcactggtaccagcagaagccaggccaggcccctgtactggtcatctatagggatatcaaccggccctctgggatccctgagcgattctctggctccaactcggggaacacggccaccctgaccatcagcagagcccaagccggggatgaggctgactattactgtcaggtgtgggacagcagcgtggtattcggcggagggaccaagctgaccgtcctc

SEQ ID NO: 1170 - DNA, 747 bp, Artificial Sequence
  Synthetic Peptide
caggtgcagctggtggagtccgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggcttacctgtgagggaaacaacattggaagtaaaaatgtgcactggtaccagcagaagccaggccaggcccctgtgctggtcatctataggaatagcaaccggccctctgggatccctgagcgattctctggctccaactcggggaacacggccaccctgactattagcagagtccaagccggggatgaggctgactattactgtcaggcgtgggacagcagcactgtggtattcggcggaggcacccagctgaccgtccta

SEQ ID NO: 1171 - DNA, 753 bp, Artificial Sequence
  Synthetic Peptide
caggtgcagctggtggagtccgggggaggcctggtcaagcctggggggtccctgagactctcctgtgcagtctctggattcaacttcagtaacaatggcatgcactgggtccgccaggctccaggcaaggggctggagtgggtggcagtcatatcgtatgatggaagtaataaatactatacagactccgtgaagggccgattcaccatctccagagacaattccaagaacacgctgtatctgcaaatgaacagcctgagaactgaggacacggctgtgtattactgtgcgaaagtttactatggttcgggtatttattataaaaagagatactactacggtatggacgtctggggccaagggaccacggtcaccgtctcctcaggtggtggtggttctggcggcggcggctccggtggtggtggttcttcatatgagctgactcagccactctcagtgtcagaggccctgggacagacggccaggattacctgtgggggaaacaacattggaagtaaaaatgtgcactggtaccagcagaagccaggccaggcccctgtactggtcatctatagggatagcaaccggccctcagggatccctgagcgattctctggctccaactctgggaacgcggccaccctgaccatcagtagggtcgaagccggggatgaggccgactattactgtcaggtgtgggatagtagcagtgatcatgtggtattcggcggaggcacccagctgaccgtccta

SEQ ID NO: 1172 - DNA, 747 bp, Artificial Sequence
  Synthetic Peptide
caggtgcagctggtggagtctgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagccaccctcggtgtcagtggccccaggacagacggccaggattacctgtgggggaaacaacattggaagtaaaaatgtgcactggtaccagcagaagccaggccaggcccctgtactggtcatctatagaaatagcaaccggccctctgggatccctgagcgattctctggctccaactctgggaacacagccactctgaccatcagcgggacccaggctatggatgaggctgactattactgtcaggcgtgggacagcagcaatgtggtattcggcggaggcacccagctgaccgtccta

SEQ ID NO: 1173 - DNA, 747 bp, Artificial Sequence
  Synthetic Peptide
caggtgcagctggtggagtccgggggaggcgtggtccagcctgggaggtccctgagactctcctgtgtagtctctggattcaacttcagtaggaatggcatgcactgggtccgccaggttccaggcagggggctagattgggtggcagttatatcaaatgatggaagtaataaatactatgcagactccgtgaagggccgattcaccatctccagagacaattccaagaacacgctgtatctgcaaatgaacagcctgagagctgaggacacggctgtgtattactgtgcgaaagtttactatggttcggggatttattataaaaataactactattacggtatggacgtctggggccaagggaccacggtcaccgtctcctcaggtggtggtggttctggcggcggcggctccggtggtggtggttcttcatatgagctgactcagccactctcagtgtcagtggccctgggacagacggccaggattacctgtgggggaaacaacattggaagtcaaaatgtgcactggtaccagcagaagccaggccaggcccctgtgctggtcatctatagggatagcaaccggccctctgggatccctgaccgattctctggctccaagtcggggaacacggccaccctgaccatcagcagagcccaagccggggatgaggctgactattactgtcaggtgtgggacagcagcactgtggttttcggcggaggcacccagctgaccgtccta

SEQ ID NO: 1174 - DNA, 747 bp, Artificial Sequence
  Synthetic Peptide
caggtgcagctggtggagtctgggggaggcgtggtccagcctgggaggtccctgagactctcctgtgtagtctctggattcaacttcagtaggaatggcatgcactgggtccgccaggttccaggcagggggctagattgggtggcagttatatcaaatgatggaagtaataaatactatgcagactccgtgaagggccgattcaccatctccagagacaattccaagaacacgctgtatctgcaaatgaacagcctgagagctgaggacacggctgtgtattactgtgcgaaagtttactatggttcggggatttattataaaaaccgctattactacggtatggacgtctggggccaagggaccacggtcaccgtctcctcaggtggtggtggttctggcggcggcggctccggtggtggtggttcttcatatgagctgactcagccaccctcggtgtcagtggccccaggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaagtcggggaccacggccaccctgaccatcagcagagcccaagccggggatgaggctgagtattactgtcaggtgtgggacagcagcactgtggttttcggcggagggaccgagctgaccgtccta

SEQ ID NO: 1175 - DNA, 747 bp, Artificial Sequence
  Synthetic Peptide
caggtgcagctggtggagtccgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgacacagccactctcagtgtcagtggccctgggacagacggccaggattacctgtgggggaaacaacattggaagtaaaaatgtgcactggtaccagcagaagccaggccaggcccctgtgctggccatctataggaatagcaaccggccctctgggatccctgagcgattcactggctccaactcggggaacacggccaccctgaccatcagcagagcccaagccggggatgagtctgactattactgtcaaatatgggacagcagcactgtggtattcggcggaggcaccaagctgaccgtccta

SEQ ID NO: 1176 - DNA, 747 bp, Artificial Sequence
  Synthetic Peptide
caggtgcagctggtggagtccgggggaggcgtggtccagcctgggaggtccctgagactctcctgtgcagcctctggattcaacttcagtaggaatggcatgcactgggtccgccaggttccaggcagggggctagattgggtggcagttatatcaaatgatggaagtaataaatactatgcggactccgtgaagggccgattcaccatctccagagacaattccaagaacacgctgtatctgcaaatgaacagcctgagagctgaggacacggctgtgtattactgtgcgaaagtttactatggttcgggtatttattataaaaagaactactactacggtatggacgtctggggccaagggaccacggtcaccgtctcctcaggtggtggtggttctggcggcggcggctccggtggtggtggttcttcatatgagctgactcagccaccctcggtgtcagtggccctgggacagacggccaggatttcctgtgggggaaacaacattggaagtaaaaatgtgcactggtaccagcagaagccaggccaggcccctgtgctggtcatctatagggatagcaaccggccctctgggatccctgagcgattctctggctccaagtcggggaccacggccaccctgaccatcagcagagcccaagccggggatgaggctgagtattactgtcaggtgtgggacagcagcactgtggttttcggcggaggcacccagctgaccgtccta

SEQ ID NO: 1177 - DNA, 747 bp, Artificial Sequence
  Synthetic Peptide
caggtgcagctggtggagtccgggggaggcgtggtccagcctgggaggtccctgagactctcctgtgcagtctctggattcaacttcagtaacaatggcatgcactgggtccgccaggctccaggcaaggggctggagtgggtggcagtcatatcgtatgatggaagtaataaatactatacagactccgtgaagggccgattcaccatctccagagacaattccaagaacacgctgtatctgcaaatgaacagcctgagaactgaggacacggctgtgtattactgtgcgaaagtttactatggttcgggtatttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgagggaaacaacattggaagtcaaaatgtgcactggtaccagcagaagccaggccaggcccctgtgctggtcatgtatagggatagcaaccggccctctgggatccctgaacgattctctggctccaagtcggggaacacggccaccctggccatcagcagagcccaagccggggatgagtctgactattactgtcaggtgtgggacggcagtgccgtggtattcggcggagggaccaagctgaccgtccta

SEQ ID NO: 1178 - DNA, 747 bp, Artificial Sequence
  Synthetic Peptide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagccactctcagtgtcagtggccctgggacagacggccaggattacctgtgagggaaacaacattggaagtcaaaatgtgcactggtaccagcagaagccaggccaggcccctgtgctggtcatgtatagggatagcaaccggccctctgggatccctgaacgattctctggctccaagtcggggaacacggccaccctggccatcagcagagcccaagccggggatgagtctgactattactgtcaggtgtgggacggcagtgccgtggtattcggcggaggcacccagctgaccgtccta

SEQ ID NO: 1179 - DNA, 747 bp, Artificial Sequence
  Synthetic Peptide
caggtgcagctggtggagtccgggggaggcgtggtccagcctgggaggtccctgagactctcctgtgcagcctctggattcaccttcagtaactatggctttcactgggtccgccagactccaggcaaggggctggagtgggtggcagttatatcatatgatggaagtaatagatactatgcagactccgtgaagggccgattcaccatctccagagacaattccaagaacacgctgtatctccaaatgaacagcctgagaggtgaggacacggcgctatattactgtgcgagagtttactatggttcggggacttattataaaaaccgctactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggacacaacattggaagtaaaggtgtgcactggtaccagcagaagccaggccaggcccctgtactggtcatctatagaaatagcaaccggccctctgggatccctgagcgattctctggctccaactctgggaacacagccactctgaccatcagcgggacccaggctatggatgaggctgactattactgtcaggcgtgggacagcggcactgtggtattcggcggaggcacccagctgaccgtccta

SEQ ID NO: 1180 - DNA, 753 bp, Artificial Sequence
  Synthetic Peptide
caggtgcagctggtggagtccgggggaggcgtggtccagcctgggaggtccctgagactctcctgtgcagcctctggattcaccttcagtaactatggctttcactgggtccgccagactccaggcaaggggctggagtgggtggcagttatatcatatgatggaagtaatagatactatgcagactccgtgaagggccgattcaccatctccagagacaattccaagaacacgctgtatctccaaatgaacagcctgagaggtgaggacacggcgctatattactgtgcgagagtttactatggttcggggacttattataaaaaccgctactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtggggcaaacaacattggaagtaaaaatgttcactggtaccagcagaagccaggccagccccctgtgctggtcatctatagagatttcaaccggccctctgggatccctgagcgattctctgcctccaactcggggaacacggccaccctgaccatcagcagaggccaagccggggatgaggctgactattactgtcaggtgtgggacagcagcactgggaatgtggtattcggcggagggaccaagctgaccgtccta

SEQ ID NO: 1181 - DNA, 747 bp, Artificial Sequence
  Synthetic Peptide
caggtgcagctggtggagtctgggggaggcgtggtccagcctgggaggtccctgagactctcctgtgcagcctctggattcatcttcagtaactatggctttcactgggtccgccagactccaggcaaggggctggagtgggtggcagttatatcatatgatggaagtaataaatactatgcagactccgtgaagggccgattcaccatctccagagacaattccaagaacacgctgtatctgcaaatgaacagcctgagaggtgaggacacggcggtgtattactgtgcgagagtttactatggttcggggagttattataaaaaccgctactactacggtatggacgtctggggccaagggaccacggtcaccgtctcctcaggtggtggtggttctggcggcggcggctccggtggtggtggttcttcatatgagctgactcagccaccctcggtgtcagtggccccaggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaagtcggggaccacggccaccctgaccatcagcagagcccaagccggggatgaggctgactattactgtcaggtgtgggacagcagcactgtggttttcggcggagggaccgagctgaccgtccta

SEQ ID NO: 1182 - DNA, 753 bp, Artificial Sequence
  Synthetic Peptide
caggtgcagctggtggagtctgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagtcatcctcggtgtcagtggccccaggacagacggccaggattacctgtgggggaaacaacattggaagtaaaaatgtgcactggtaccagcagaagccaggccaggcccctgtgttggtcatctatagggatagcaaccggccctctgggatccctgagcgattctctggctccaagtcggggaccacggccaccctgaccatcagcagggtcgaagccggggatgaggccgactattactgtcaggtgtgggatagtagtagtgctcatgtgatattcggcggagggaccaagctgaccgtccta

SEQ ID NO: 1183 - DNA, 747 bp, Artificial Sequence
  Synthetic Peptide
caggtgcagctggtggagtccgggggaggcgtggtccagcctgggaggtccctgagactctcctgtggagcctctggattcaccttcagtggctatggcatgcactgggtccgccaggctccaggcaaggggctggagtgggtggcagttatatcatatgatggaagtaataaatactatgcagactccgtgaagggccgattcaccatctcaagagacaattccaagaacacgctgtatctgcaaatgaacagcctgagaggtgaggacacggcggtgtattactgtgcgagagtttattatggttcggggatttattataaaaaccgctactactacggtatggacgtctggggccaagggaccacggtcaccgtctcctcaggtggtggtggttctggcggcggcggctccggtggtggtggttcttcatatgagctgactcagccaccctcagggtcagtggccctgggacagacggccaggatcacctgtgggggaaacaaccttggaagtaaaaatgtgcactggtaccaacagaagccaggccaggcccctgtgctggtcatctatagaaatagcaaccggccctctgggatccctgagcgattctctggctccaactcggggaacacggccaccctgaccatcagcagagcccaggccggggatgaggctgactattactgtcaggtgtgggacagcagcactgtggtattcggcggtgggaccaagctgaccgtccta

SEQ ID NO: 1184 - DNA, 747 bp, Artificial Sequence
  Synthetic Peptide
caggtgcagctggtggagtctgggggaggcctggtcaagcctggggggtccctgagactctcctgtgcagcctctggattcaccttcagtaacaatggcatgcactgggtccgccaggctccaggcaaggggctggagtgggtggcagtcatatcgtatgatggaagtaataaatactatgcggactccgtgaagggccgattcaccatctccagagacaattccaagaacacgctgtatctgcaaatgaacagcctgagagctgaggacacggctgtgtattactgtgcgaaagtttattatggttcggggatttattataaaaacaggtattactacgggatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggaaacagaattggaagtaaaaatgtgcactggtaccagcagaagccaggccaggcccctgtgttggtcatctatagggatagcaaccggccctctgggatccctgagcgattctctggctccaagtcggggaccacggccaccctgaccatcagcagagcccaagccggggatgaggctgagtattactgtcaggtgtgggacagcagcactgtggttttcggcggagggaccaagctgaccgtccta

SEQ ID NO: 1185 - DNA, 747 bp, Artificial Sequence
  Synthetic Peptide
caggtgcagctggtggagtctgggggaggcgtggtccagcctgggaggtccctgagactctcctgtgcagcctctggattcaccttcagtaactatggctttcactgggtccgccagactccaggcaaggggctggagtgggtggcagttatatcatatgatggaagtaatagatactatgcagactccgtgaagggccgattcaccatctccagagacaattccaagaacacgctgtatctccaaatgaacagcctgagaggtgaggacacggcgctatattactgtgcgagagtttactatggttcggggacttattataaaaaccgctactactacggtatggacgtctggggccaagggaccacggtcaccgtctcctcaggtggtggtggttctggcggcggcggctccggtggtggtggttcttcatatgagctgacacagctaccttcagtgtcagtggccctgggacagacggccaggattacctgtgggggacacaacattggaagtaaaggtgtgcactggtaccagcagaagccaggccaggcccctgtgctggtcatctatagaaatagcaaccggccctctgggatccctgagcgattctctggctccaactcggggaacacggccaccctgaccatcagcagagcccaagccggggatgaggctgactattactgtcaggtgtgggacagcagcactgtggttttcggcggagggaccgagctgaccgtccta

SEQ ID NO: 1186 - DNA, 747 bp, Artificial Sequence
  Synthetic Peptide
caggtgcagctggtggagtctgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaaccgctattactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggacacaacattggaagtaaaggtgtgcactggtaccagcagaagccaggccaggcccctgtgctggtcatctatagaaatagcaaccggccctctgggatccctgagcgattctctggctccaactcggggaacacggccaccctgaccatcagcagagcccaagccggggatgaggctgactattactgtcaggtgtgggacagtagtactgtggttttcggcggaggcacccagctgaccgtccta

SEQ ID NO: 1187 - DNA, 747 bp, Artificial Sequence
  Synthetic Peptide
caggtgcagctggtggagtctgggggagacttggtacagcctgggaggtccctgagactctcctgtgcagcgtctggattcaccttcagtaacaatggcatgcactgggtccgccaggctccaggcaagggactggagtgggtggcagttatttcaaatgatggcagtaataaatattatgcagattccgtgaggggccgattcaccatctccagagacaattccaagaacacgctgtatctgcaaatgaacagcctgagagctgaggacacggctgtgtattattgtgcgaaagtttactatggttcgggtatttattataaaaacaggtactactacgggatggacgtctggggccaagggaccacggtcaccgtctcctcaggtggtggtggttctggcggcggcggctccggtggtggtggttcttcatatgagctgactcagccactctcagtgtcagtggccctgggacagacggccaggattacctgtgggggaaacaacattggaagtaaaaatgtgcactggtaccagcagaagccaggccaggcccctgtgctggtcatctataggaatagcaaccggccctctgggatccctgagcgattctctggctccaactcggggaacacggccaccctgactcttagcagagtccaagccggggatgaggctgactattactgtcaggtgtgggacagcagcactgtggttttcggcggagggaccaagctgaccgtccta

SEQ ID NO: 1188 - DNA, 747 bp, Artificial Sequence
  Synthetic Peptide
caggtgcagctggtggagtccgggggaggcgtggtccagcctgggaggtccctgagactctcctgtgcagtctctggattcaacttcagtaacaatggcatgcactgggtccgccaggctccaggcaagggactggagtgggtggcagttatttcaaatgatggcagtaataaatattatgcagattccgtgaggggccgattcaccatctccagagacaattccaagaacacactgtatctgcaaatggacagcctgagaactgaggacacggctgtgtattactgtgcgaaagtttactatggttcgggtatttattataaaaacaggtactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggcttacctgtgagggaaacaacattggaagtaaaaatgtgcactggtaccagcagaagccaggccaggcccctgtgttggtcatctatagggatagcaaccggccctctgggatccctgagcgcttctctggctccaagtcggggaacacggccaccctggccatcagcagagcccaagccggggatgagtctgactattactgtcaggtgtgggacagcagtgccgtggtattcggcggaggcaccaagctgaccgtccta

SEQ ID NO: 1189 - DNA, 747 bp, Artificial Sequence
  Synthetic Peptide
caggtgcagctggtggagtccgggggaggcgtggtccagcctgggaggtccctgagactctcctgtgcagcctctggattcaccttcagtagctctggcatgcactgggtccgccaggctccaggcaaggggctggagtgggtggcagttatatcaaatgatggaagtaataaatactatgcagactccgtgaagggccgattcaccatctccagagacaattccaagaacacgctgtatctgcaaatgaacagcctgagagctgaggacacggctgtgtattactgtgcgaaagtttactatggttcggggatttattataaaaataactactattacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggaaacaacattggaagtaaaaatgtgcactggtaccagcagaagccaggccaggcccctgtgctggccatctataggaatagcaaccggccctctgggatccctgagcgattcactggctccaactcggggaacacggccaccctgaccatcagcgggacccaggctatggatgaggctgactattactgtcaggcgtgggacagcagcactgtggtattcggcggagggaccaagctgaccgtccta

SEQ ID NO: 1190 - DNA, 747 bp, Artificial Sequence
  Synthetic Peptide
caggtgcagctggtggagtctgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggattacctgtgggggaaacaacattggaagtcaaaatgtgcactggtaccagcagaagccaggccaggcccctgtgctggtcatctatagggatagcaaccggccctctgggatccctgagcgcttctctggctccaagtcggggaacacggccaccctggccatcagcagagcccaagccggggatgagtctgactattactgtcaggtgtgggacagcagtgccgtggtattcggcggaggcacccagctgaccgtccta

SEQ ID NO: 1191 - DNA, 747 bp, Artificial Sequence
  Synthetic Peptide
caggtgcagctggtggagtccgggggaggcgtggtccagcctgggaggtccctgagactctcctgtgcagcctctggattcaccctcagtagctctggcatgcactgggtccgccaggctccaggcaaggggctggagtgggtggcagttatatcaaatgatggaagtaataaatactatgcggactccgtgaagggccggttcaccatctccagagacgattccaagaacacactgtatctgcaaatggacagcctgagaactgaggacacggctgtgtattactgtgcgaaagtttactatggttcgggtatttattataaaaacaggtactactacgggatggacgtctggggccaagggaccacggtcaccgtctcctcaggtggtggtggttctggcggcggcggctccggtggtggtggttcttcatatgagctgactcagccaccctcagtgtcagtggccctgggacagacggccaggatttcctgtgggggaaacaacattggaagtaaaaatgtgcactggtaccagcagaagccaggccaggcccctgtgctggtcatgtatagggatagcaaccggccctcagggatccctgagcgattctctggctccaactctgggaacacagccactctgaccatcagcgggacccaggctatggatgaggctgactattactgtcaggcgtgggacagcggcactgtggtattcggcggagggaccaagctgaccgtccta

SEQ ID NO: 1192 - DNA, 747 bp, Artificial Sequence
  Synthetic Peptide
caggtgcagctggtggagtctgggggaggcgtggtccagcctgggaggtccctgagactctcctgtgcagcctctggattcaacttcagtaactatggcatgcactgggtccgccaggctccaggcaaggggctggaatgggtggcagttatatcatatgatggaagtaataaatattatgcagactccgtgaagggccgattcaccatctccagagacaattccaagaacacgctgtatctacaaatgaacagcctgagagctgaggacacggctgtgtatttctgtgcgagagtttactatggttcggggatttattataaaaagagatactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccagaattacctgtgggggaaacaacattggaggtaaaaatgtgcactggtaccagcagaagccaggccaggcccctgtgctggtcatctatagggatagcaaccggccctctgggatccctgagcgattctctggctccaagtcggggaacacggccaccctgaccatcagcagagcccaagccggggatgagtctgactattactgtcaggtgtgggacagcagcactgtggtattcggcggaggcacccagctgaccgtccta

SEQ ID NO: 1193 - DNA, 747 bp, Artificial Sequence
  Synthetic Peptide
caggtgcagctggtggagtctgggggaggcgtggtccagcctgggaggtccctgagactctcctgtgtagtctctggattcaacttcagtaggaatggcatgcactgggtccgccaggttccaggcagggggctagattgggtggcagttatatcaaatgatggaagtaataaatactatgcagactccgtgaagggccgattcaccatctccagagacaattccaagaacacgctgtatctgcaaatgaacagcctgagagctgaggacacggctgtgtattactgtgcgaaagtttactatggttcggggatttattataaaaataactactattacggtatggacgtctggggccaagggaccacggtcaccgtctcctcaggtggtggtggttctggcggcggcggctccggtggtggtggttcttcatatgagctgactcagccactctcagtgtcagtggccctgggacagacggccaggattacctgtgggggaaacaacattggaagtaaaaatgtgcactggtaccagcagaagccaggccaggcccctgtgctggtcatctatagaaatagcaaccggccctctgggatccctgagcgattctctggctccaactcggggaacacggccaccctgaccatcagcagagcccaggccggggatgaggctgactattactgtcaggtgtgggacagcagcactgtggttttcggcggtgggaccaagctgaccgtccta

SEQ ID NO: 1194 - DNA, 747 bp, Artificial Sequence
  Synthetic Peptide
caggtgcagctggtggagtccgggggaggcttggtcaagcctggagggtccctgagactctcctgtgcagcctctggattcaacttcagtaggaatggcatgcactgggtccgccaggttccaggcagggggctagattgggtggcagttatatcaaatgatggaagtaataaatactatgcagactccgtgaagggccgattcaccatctccagagacaattccaagaacacgctgtatctgcaaatgaacagcctgagagctgaggacacggctgtgtattactgtgcgaaagtttactatggttcggggatttattataaaaataactactactacggtatggacgtctggggccaagggaccacggtcaccgtctcctcaggtggtggtggttctggcggcggcggctccggtggtggtggttcttcatatgagctgactcagccaccctcagtgtcagtggccctgggacagacggccaggatttcctgtgggggaaacaacattgaaagtaaaaatgtgcactggtaccagcagaagccaggccaggcccctgtgttggtcatctatagggatagcaaccggccctctgggatccctgagcgattctctggctccaagtcggggaccacggccaccctgaccatcagcagagcccaagccggggatgaggctgagtattactgtcaggtgtgggacagcagcactgtggttttcggcggaggcacccagctgaccgtccta

SEQ ID NO: 1195 - DNA, 1404 bp, Artificial Sequence
  Synthetic Peptide
atggacatgagggtgcccgctcagctcctggggctcctgctgctgtggctgagaggtgcgcgctgtgaggtgcagctggtggagtctgggggaggcttggtaaagcctggggggtccctgagactctcctgtgcagcctctggatttactttcagtaacgcccggatgggctgggtccgccaggctccagggaaggggctggagtgggttggccgtattaaaagcaaaactgaaggtgggacaagagactacgctgcacccgtgaaaggcagattcaccatctcaagagatgattcaaaaaacacgctgtatctgcaaatgaacagcctgaaaaccgaggacacagccgtgtattattgtacctcgtatagtggggtctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1196 - DNA, 729 bp, Artificial Sequence
  Synthetic Peptide
atggacatgagggtgcccgctcagctcctggggctcctgctgctgtggctgagaggtgcgcgctgtgacatcgtgatgacccagtctccagactccctggctgtgtctctgggcgagagggccaccatcaactgcaagtccagccagagtgttttatacagttccaacaatagaaactacttagcttggtaccatcagaaaccaggacagtctcctaagctgctcatttcctgggcatctacccgggaatccggggtccctgaccgattcagtggcagcgggtctgggacagatttcactctcaccatcaacagcctgcaggctgaagatgtggcagtttattactgtcaacaatattatagtattccgatcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1197 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtccgggggaggcgtggtccagcctgggaggtccctgagactctcctgtgcagcctctggattcaccttcagtaactatggctttcactgggtccgccagactccaggcaaggggctggagtgggtggcagttatctcatatgatggaagtaatagatactatgcaagctccgtgaagggccgattcaccatctccagagacaattccaagaacacgctgtatctccaaatgaacagcctgagaggtgaggacacggcgctatattactgtgcgagagtttactatggttcggggacttattataaaaaccgctactactacggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1198 - DNA, 696 bp, Artificial Sequence
  Synthetic Peptide
atggcctgggctctgctgctcctcaccctcctcactcagggcacagggtcctgggcctcatatgagctgactcagccaccctcagtgtcagtggccctgggacagacggccaggattacctgtgggggacacaacattggaagtaaaggtgtgcactggtaccagcagaagccaggccaggcccctgtactggtcatctatagagccgccaaccggccctctgggatccctgagcgattctctggctccaactctgggaacacagccactctgaccatcagcgggacccaggctggcgatgaggctgactattactgtcaggcgttcgacgccggcactgtggtattcggcggaggcacccagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1199 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtccgggggaggcgtggtccagcctgggaggtccctgagactctcctgtgcagcctctggattcaccttcagtaactatggctttcactgggtccgccagactccaggcaaggggctggagtgggtggcagttatctcatatgccggaagtaatagatactatgcagcctccgtgaagggccgattcaccatctccagagacaattccaagaacacgctgtatctccaaatgaacagcctgagaggtgaggacacggcgctatattactgtgcgagagtttactatggttcggggacttattataaaaaccgctactactacggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1200 - DNA, 696 bp, Artificial Sequence
  Synthetic Peptide
atggcctgggctctgctgctcctcaccctcctcactcagggcacagggtcctgggcctcatatgagctgactcagccaccctcagtgtcagtggccctgggacagacggccaggattacctgtgggggacacaacattggaagtaaaggtgtgcactggtaccagcagaagccaggccaggcccctgtactggtcatctatagacagagcaaccggccctctgggatccctgagcgattctctggctccaactctgggaacacagccactctgaccatcagcgggacccaggctgaagatgaggctgactattactgtcaggcgttcgacgccggcactgtggtattcggcggaggcacccagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1201 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtccgggggaggcgtggtccagcctgggaggtccctgagactctcctgtgcagcctctggattcaccttcagtaactatggctttcactgggtccgccagactccaggcaaggggctggagtgggtggcagttatctcatatagcggaagtaatagatactatgcagactccgtgaagggccgattcaccatctccagagacaattccaagaacacgctgtatctccaaatgaacagcctgagaggtgaggacacggcgctatattactgtgcgagagtttactatggttcggggacttattataaaaaccgctactactacggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1202 - DNA, 696 bp, Artificial Sequence
  Synthetic Peptide
atggcctgggctctgctgctcctcaccctcctcactcagggcacagggtcctgggcctcatatgagctgactcagccaccctcagtgtcagtggccctgggacagacggccaggattacctgtgggggacacaacattggaagtaaaggtgtgcactggtaccagcagaagccaggccaggcccctgtactggtcatctatagacagagcaaccggccctctgggatccctgagcgattctctggctccaactctgggaacacagccactctgaccatcagcgggacccaggctggcgatgaggctgactattactgtcaggcgttcgacgccggcactgtggtattcggcggaggcacccagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1203 - DNA, 696 bp, Artificial Sequence
  Synthetic Peptide
atggcctgggctctgctgctcctcaccctcctcactcagggcacagggtcctgggcctcctatgaactgactcagccactctcagtgtcagtggccctgggacagacggccaggattacctgtgggggacacaacattggaagtaaaggtgtgcactggtaccagcagaagccaggccaggcccctgtgctggtcatctatagaaatagcaaccggccctctgggatccctgagcgattctctggctccaactcggggaacacggccaccctgaccatcagcagagcccaagccggggatgaggctgactattactgtcaggtgtgggacatcagcactgtggttttcggcggagggaccgagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1204 - protein, 1443 aa, Artificial Sequence
  Synthetic Peptide
ATGGACATGAGGGTGCCCGCTCAGCTCCTGGGGCTCCTGCTGCTGTGGCTGAGAGGTGCGCGCTGTCAGGTGCAGCTGGTGGAGTCTGGGGGAGGCGTGGCCCAGCCTGGGAGGTCCCTGAGACTCTCCTGTGCAGCCTCTGGATTCAACTTCAGTAACTGTGGCATGCACTGGGTCCGCCAGGCTCCAGGCAAGGGGCTGGAGTGGGTGGCAGTTATATCATATGATGGAGGTAATAAATATCATGCGGACTCCGTGAAGGGCCGGTTCACCATCTCCAGAGACGATTCCAAGAACACACTGTATCTGCAAATGGACAGCCTGAGAACTGAGGACACGGCTGTGTATTACTGTGCGAAAGTTTACTATGGTTCGGGTATTTATTATAAAAACAGGTACTACTACGGGATGGACGTCTGGGGCCAAGGGACCACGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAATAG

SEQ ID NO: 1205 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggacacaacattggaagtaaaggtgtgcactggtaccagcagaagccaggccaggcccctgtgctggtcatctatagaaatagcaaccggccctctgggatccctgagcgattctctggctccaactcggggaaaacggccaccctgaccatcagcagagcccaagccggggatgaggctgactattactgtcaggtgtgggacagcagcactgtggttttcggcggagggaccgagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1206 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtctgggggaggcgtggcccagcctgggaggtccctgagactctcctgtgcagcctctggattcaacttcagtaactgtggcatgcactgggtccgccaggctccaggcaaggggctggagtgggtggcagttatatcatatgatggaggtaataaatattatgcggactccgtgaagggccggttcaccatctccagagacgattccaagaacacactgtatctgcaaatggacagcctgagaactgaggacacggctgtgtattactgtgcgaaagtttactatggttcgggtatttattataaaaacaggtattactacgggatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1207 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggaaacaacattggaagtaaaaatgtgcactggtaccagaagaggccaggccaggcccctgtgctggtcatctatagggatagcaaccggccctctgggatccctgagcgattctctggctccaagtcggggaacacggccaccctgaccatcagcagagcccaagccggggatgaggctgactattactgtcaggtgtgggacagcaacactgtggttttcggcggagggaccaacctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1208 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgtagtctctggattcaacttcagtaacaatggcatgcactgggtccgccaggctccaggcaagggactggagtgggtggcagttatttcaaatgatggcagtaataaatattatgcagattccgtgaggggccgattcaccatctccagagacaattccaagaacacgctgtatctgcaaatgaacagcctgagagctgaggacacggctgtgtattcctgtgcgaaagtttactatggttcgggaatttattacaaaaataactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1209 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggaaacaacattggaagtaaaaatgtgcactggtaccagcagaaggcaggccaggcccctgtgcaggtcatctatagaaatagcaaccggccctctgggatccctgagcgattctctggctccaactcggggaacacggccaccctgaccatcagcagagcccaggccggggatgaggctgactattactgtcaggtgtgggacagcagcactgtggttttcggcggtgggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1210 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcctctggattcaacttcaatacctatggcatgcactgggtccgccaggctccaggcaaggggctggagtgggtggcagttatatcatatgatggaagtaataaatattatgcagactccgtgaagggccgattcaccatctccagagacaattccaagagcacgctgtatctgcaaatgaacagcctgagagctgaggacacggctgtgtattactgtgcgagagtttactatggttcggggagttattataaaaagaattactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1211 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggaaacaacattggaggtaaaaatgtgcactggtaccagcagaagccaggccaggcccctgtgctggtcatctatagggatagcaaccggccctctgggatccctgagcgattctctggctccaagtcggggaacacggccaccctgaccatcagcagagcccaagccggggatgagtctgactattactgtcaggtttgggacagcagcactgtggtattcggcggagggaccacgctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1212 - DNA, 1443 bp, Artificial Sequence
  Synthetic Peptide
atggacatgagggtgcccgctcagctcctggggctcctgctgctgtggctgagaggtgcgcgctgtcaggtgcaggtggtggagtctgggggaggcgtggtccagcctgggaggtccctgagactctcctgtgcagcctctggattcaccctcagtagttatggctttcactgggtccgccagactccaggcaaggggctggagtgggtggcagttatatcatatgatggaagtaataaatactatgcagactccgtgaagggccgattcaccatctccagagacaattccaagaacacgctgtatctccaaatgaacagcctgagaggtgaggacacggcggtgtattactgtgcgagagtttactatggttcggggacttattataaaaaccgctactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1213 - DNA, 696 bp, Artificial Sequence
  Synthetic Peptide
atggcctgggctctgctgctcctcaccctcctcactcagggcacagggtcctgggcctcctatgagctgactcagccactctcagtgtcagaggccctgggacagacggccaggattacctgtgggggaaacaacattggaagtaaaaatgtgcactggtaccagcagaagccaggccaggcccctgtactggtcatctatagggatagcaaccggccctctgggatccctgagcgattctctggctccaagtcggggaacacggccaccctgaccatcagcagagcccaagccggggatgaggctgactattactgtcaggtgtgggacagcagcactgtggttttcggcggagggaccaaggtgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1214 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgtagtctctggattcaacttcattaacaatggcatgcactgggtccgccaggctccaggcaaggggctggactgggtggcagttatatcaaatgatggaagtaataaatactatccagactccgtgaagggccgattcaccatctccagagacaattccaagaacacgctgtatctgcaaatgaacagcctgagagctgaggactcggctgtgtattactgtgcgaaagtttactatggttcgggaaattattataaaaacaactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1215 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgagggaaacaacattggaagtcaaaatgtgcactggtaccagcagaagccaggccaggcccctgtgctggtcatgtatagggatagcaaccggccctctgggatccctgaacgattctctggctccaagtcggggaacacggccaccctggccatcagcagagcccaagccggggatgagtctgactattactgtcaggtgtgggacggcagtgccgtggtattcggcggagggaccacgctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1216 - DNA, 1443 bp, Artificial Sequence
  Synthetic Peptide
atggacatgagggtgcccgctcagctcctggggctcctgctgctgtggctgagaggtgcgcgctgtcagatgcaggtggtggagtctgggggaggcgtggtccagcctgggaggtccctgagactctcctgtgcagcctctggattcaccttcagtagctctggcatgcactgggtccgccaggctccaggcaagggcctggagtgggtggcagttatatcacatgatggaagtaataaatactatgcagactccgtgaagggccgattcaccatctccagagacaattccaagaacacgctgtatctgcaaatgaatagcctgggaggtgaggacacggcggtgtattactgtgcgaaagtttactatggttcggggatttattataaaaaccgctattactacggtatggacgtctggggccaagggaccacggtcatcgtctcgtcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1217 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggacacaacattggaagtaaaggtgtgcactggtaccagcagaagccaggccaggcccctgtgctggtcatctatagaaatagcaaccggccctctgggatccctgagcgattctctggctccaactcggggaacacggccaccctgaccatcagcagagcccaagccggggatgaggctgactattactgtcaggtgtgggacagcagcactgtggttttcggcggagggaccgagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1218 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtctgggggaggcgtggcccagcctgggaggtccctgagactctcctgtgcagcctctggattcaacttcagtgattgtggcatgcactgggtccgccaggctccaggcaaggggctggagtgggtggcagttatatcatatgatggaggtaataaatattatgcggactccgtgaagggccggttcaccatctccagagacgattccaagaacacactgtatctgcaaacggacagcctgagaactgaggacacggctgtgtattactgtgcgaaagtttactatggttcgggtatttattataaaaacaggtactactacgggatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1219 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacgggcaggattacctgtgggggaaacaacattggaagtaaaaatgtgcactggtaccagcagaagccaggccaggcccctgtgctggtcatctataggagtagcaaccggccctctgggatccctgagcgattctctggctccaactcggggaacacggccaccctgaccatcagcagagcccaagccggggatgagtctgactattactgtcaaatatgggacagcagcactgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1220 - DNA, 1443 bp, Artificial Sequence
  Synthetic Peptide
atggacatgagggtgcccgctcagctcctggggctcctgctgctgtggctgagaggtgcgcgctgtcaggtgcaggtggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatttgatggaaataataaatactatgcagactccgtgaagggccgattcaccatctccagagacaattccaagaacacgctatatctgcaaatgaacagcctgagaggtgaggacacggcggtgtattactgtgcgagagtttattatggttcggggagttattataaaaaccgctactactacggtatggacgtctggggccaagggaccacggtcaccgtctccacagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1221 - DNA, 696 bp, Artificial Sequence
  Synthetic Peptide
atggcctgggctctgctgctcctcaccctcctcactcagggcacagggtcctgggcctcctatgaactgactcagccactctcagtgtcagtggccctgggacagacggccaggattacctgtgggggaaacaacattggaagtaaaaatgtacactggtaccagcagaggccaggccaggcccctgtgttggtcatctacagggatagcaaccggccctctgggatccctgagcgattatctggctccaaagcggggaacacggccaccctgaccatcagcagagcccacgccggggatgaggctgactattactgtcaggtgtgggacagcagcactgtggttttcggcggagggaccgagctgaccgtccaaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1222 - DNA, 1443 bp, Artificial Sequence
  Synthetic Peptide
atggacatgagggtgcccgctcagctcctggggctcctgctgctgtggctgagaggtgcgcgctgtcaggtgcaattggtggagtctgggggaggcgtggtccagcctgggaggtctctgagactctcctgtgcagtctctggattcacgttcagtagcaatggcatgcactgggtccgccaggctccaggcaaggggctggagtgggtggcagttatatcaaatgatggaagtaataaatattatggagactccgtgaagggccgattcaccatctccagagacaattccaagaacacgctgtatctgcaaatgaacagcctgagagctgaggacacggctgtgtattactgtgcgaaagtttactatggttcgggaatttattacagaaacaactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1223 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggaaacaacattggaagtaaaaatgtgcactggtaccagcagaagccaggccaggcccctatactggtcatctataggaataccaaccggccctctgggatccctgagcgattctctggctccaactcggggaacacggccaccctgaccatcagcagagcccaagtcggggatgagtctgactatttctgtcaggtgtgggacagcagcactgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1224 - DNA, 1443 bp, Artificial Sequence
  Synthetic Peptide
atggacatgagggtgcccgctcagctcctggggctcctgctgctgtggctgagaggtgcgcgctgtcaggtgcaggtggtggagtctgggggaggcgtggtccagcctgggaggtccctgagactctcctgtggagcctctggattcaccttcagtggctatggcatgcactgggtccgccaggctccaggcaaggggctggagtgggtggcagttatatcatatgatggaagtaataaatactatgcagactccgtgaagggccgattccccatctcaagagacaattccaagaacacgctgtatctgcaaatgaacagcctgagaggtgaggacacggcggtgtattactgtgcgagagtttattatggttcggggatttattataaaaaccgctactactacggtatggacgtctggggccaagggaccacggtcgccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1225 - DNA, 696 bp, Artificial Sequence; identical to SEQ ID NO: 1223
  Synthetic Peptide

SEQ ID NO: 1226 - DNA, 1443 bp, Artificial Sequence
  Synthetic Peptide
atggacatgagggtgcccgctcagctcctggggctcctgctgctgtggctgagaggtgcgcgctgtcaggtgcaggtggtggagtctgggggaggcgtggtccagcctgggaggtccctgagactctcctgtggagcctctggattcaccttcagtggctatggcatgcactgggtccgccaggctccaggcaaggggctggagtgggtggcagttatatcatatgatggaagtaataaatactatgcagactccgtgaagggccgattcaccatctcaagagacaattccaagaacacgctgtatctgcaaatgaacagcctgagaggtgaggacacggcggtgtattactgtgcgagagtttattatggttcggggatttattataaaaaccgctactactacggtatggacgtctggggccaagggaccacggtcgccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1227 - DNA, 696 bp, Artificial Sequence
  Synthetic Peptide
atggcctgggctctgctgctcctcaccctcctcactcagggcacagggtcctgggcctcctatgacctgactcagccactctcagtgtcagtggccctgggacagacggccaggattacctgtgggggaaacaacattggagataaaaatgtgcactggtaccagcagaagccaggccaggcccctgtgctggtcatctataggaataacgtccggccctctgggatccctgagcgattctctggctccaactcggggaacacggccaccctgaccatcagcagagcccaagccggggatgaggctgactattactgtcaggtgtgggacagcagcactgtggttttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1228 - DNA, 1443 bp, Artificial Sequence
  Synthetic Peptide
atggacatgagggtgcccgctcagctcctggggctcctgctgctgtggctgagaggtgcgcgctgtcaggtgcagctggtggaatctgggggaggcgtggtccagcctgggaggtccctgagactctcctgtgcagcctctgggctcaacttcagtaactttggcatgcactgggtccgccaggctccaggcaaggggctggactgggtggcagttatatcatatgatggaggtaataaatactatgcagactccgtgaagggccgattcaccgtctccagagacaattccaagaacacgctctttctgcaaatgaacagcctgagagctgaggacacggctctgtattactgtgcgaaagtttactatggctcgggcagttattataaaaagaggtactactacggtatggacgtctggggccaggggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1229 - DNA, 696 bp, Artificial Sequence
  Synthetic Peptide
atggcctgggctctgctgctcctcaccctcctcactcagggcacagggtcctgggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaagtcggggaacacggccaccctgaccatcagcagagcccaagccggggatgaggctgactattactgtcaggtgtgggacagcagcactgtggttttcggcggaggggccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1230 - DNA, 1443 bp, Artificial Sequence
  Synthetic Peptide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcctctggattcaacttcagtagctgtggcatgcactgggtccgccaggctccaggcaaggggctggagtgggtggcagttatatcatatgatggaactaataaatactatgcggactccgtgaagggccgattcaccatctccagagacaattccaagaacacgctgtatctgcaaatgaacagcctgagagctgaggacacggctgtgtattactgtgcgaaagtttactatggttcgggtatttattataaaaagaactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1231 - DNA, 1404 bp, Artificial Sequence
  Synthetic Peptide
atggacatgagggtgcccgctcagctcctggggctcctgctgctgtggctgagaggtgcgcgctgtgaggtgcagctggtggagtctgggggaggcttggtaaagcctggggggtccctgagactctcctgtgcagcctctggatttactttcagtaacgcccggatgggctgggtccgccaggctccagggaaggggctggagtgggttggccgtattaaaagcaaaactgaaggtgggacaagagactacgctgcacccgtgaaaggcagattcaccatctcaagagatgattcaaaaaacacgctgtatctgcaaatgaacagcctgaaaaccgaggacacagccgtgtattattgtacctcgtatagtggggtctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1232 - DNA, 729 bp, Artificial Sequence
  Synthetic Peptide
atggacatgagggtgcccgctcagctcctggggctcctgctgctgtggctgagaggtgcgcgctgtgacatcgtgatgacccagtctccagactccctggctgtgtctctgggcgagagggccaccatcaactgcaagtccagccagagtgttttatacagttccaacaataagaactacttagcttggtaccatcagaaaccaggacagtctcctaagctgctcatttcctgggcatctacccgggaatccggggtccctgaccgattcagtggcagcgggtctgggacagatttcactctcaccatcaacagcctgcaggctgaagatgtggcagtttattactgtcaacaatattatagtattccgatcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1233 - protein, 5 aa, Artificial Sequence
  Synthetic Peptide
  X (1)..(1): N, S, D, G, T, or R
  X (2)..(2): C, N, Y, S, or F
  X (4)..(4): M or F
XXGXH

SEQ ID NO: 1234 - protein, 7 aa, Artificial Sequence
  Synthetic Peptide
  X (2)..(2): A, N, D, S, or Q
  X (3)..(3): S, T, N, I, F, or A
  X (4)..(4): N or V
RXXXRPS

SEQ ID NO: 1235 - protein, 17 aa, Artificial Sequence
  Synthetic Peptide
  X (13)..(13): K or R
KSSQSVLYSSNNXNYLA

SEQ ID NO: 1236 - protein, 114 aa, Artificial Sequence
  Synthetic Peptide
  X (36)..(36): K or R
  X (43)..(43): H or Q
  X (49)..(49): S or P
DIVMTQSPDSLAVSLGERATINCKSSQSVLYSSNNXNYLAWYXQKPGQXPKLLISWASTRESGVPDRFSGSGSGTDFTLTINSLQAEDVAVYYCQQYYSIPITFGGGTKVEIKR

SEQ ID NO: 1237 - protein, 444 aa, Artificial Sequence; identical to SEQ ID NO: 573
  Synthetic Peptide

SEQ ID NO: 1238 - protein, 457 aa, Artificial Sequence
  Synthetic Peptide
QVQLVESGGGVVQPGRSLRLSCAASGFTFSNYGFHWVRQTPGKGLEWVAVISYDGSNRYYASSVKGRFTISRDNSKNTLYLQMNSLRGEDTALYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1239 - protein, 457 aa, Artificial Sequence
  Synthetic Peptide
QVQLVESGGGVVQPGRSLRLSCAASGFTFSNYGFHWVRQTPGKGLEWVAVISYAGSNRYYAASVKGRFTISRDNSKNTLYLQMNSLRGEDTALYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1240 - protein, 457 aa, Artificial Sequence
  Synthetic Peptide
QVQLVESGGGVVQPGRSLRLSCAASGFTFSNYGFHWVRQTPGKGLEWVAVISYSGSNRYYADSVKGRFTISRDNSKNTLYLQMNSLRGEDTALYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1241 - protein, 457 aa, Artificial Sequence
  Synthetic Peptide
QVQLVESGGGVAQPGRSLRLSCAASGFNFSNCGMHWVRQAPGKGLEWVAVISYDGGNKYHADSVKGRFTISRDDSKNTLYLQMDSLRTEDTAVYYCAKVYYGSGIYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1242 - protein, 457 aa, Artificial Sequence
  Synthetic Peptide
QVQLVESGGGVAQPGRSLRLSCAASGFNFSNCGMHWVRQAPGKGLEWVAVISYDGGNKYYADSVKGRFTISRDDSKNTLYLQMDSLRTEDTAVYYCAKVYYGSGIYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1243 - protein, 457 aa, Artificial Sequence
  Synthetic Peptide
QVQLVESGGGVVQPGRSLRLSCVVSGFNFSNNGMHWVRQAPGKGLEWVAVISNDGSNKYYADSVRGRFTISRDNSKNTLYLQMNSLRAEDTAVYSCAKVYYGSGIYYKNNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1244 - protein, 457 aa, Artificial Sequence
  Synthetic Peptide
QVQLVESGGGVVQPGRSLRLSCAASGFNFNTYGMHWVRQAPGKGLEWVAVISYDGSNKYYADSVKGRFTISRDNSKSTLYLQMNSLRAEDTAVYYCARVYYGSGSYYKKNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1245 - protein, 457 aa, Artificial Sequence
  Synthetic Peptide
QVQVVESGGGVVQPGRSLRLSCAASGFTLSSYGFHWVRQTPGKGLEWVAVISYDGSNKYYADSVKGRFTISRDNSKNTLYLQMNSLRGEDTAVYYCARVYYGSGTYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1246 - protein, 457 aa, Artificial Sequence
  Synthetic Peptide
QVQLVESGGGVVQPGRSLRLSCVVSGFNFINNGMHWVRQAPGKGLDWVAVISNDGSNKYYPDSVKGRFTISRDNSKNTLYLQMNSLRAEDSAVYYCAKVYYGSGNYYKNNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1247 - protein, 457 aa, Artificial Sequence
  Synthetic Peptide
QMQVVESGGGVVQPGRSLRLSCAASGFTFSSSGMHWVRQAPGKGLEWVAVISHDGSNKYYADSVKGRFTISRDNSKNTLYLQMNSLGGEDTAVYYCAKVYYGSGIYYKNRYYYGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1248 - protein, 457 aa, Artificial Sequence
  Synthetic Peptide
QVQLVESGGGVAQPGRSLRLSCAASGFNFSDCGMHWVRQAPGKGLEWVAVISYDGGNKYYADSVKGRFTISRDDSKNTLYLQTDSLRTEDTAVYYCAKVYYGSGIYYKNRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1249 - protein, 457 aa, Artificial Sequence
  Synthetic Peptide
QVQVVESGGGVVQPGRSLRLSCAASGFTFSSYGMHWVRQAPGKGLEWVAVISFDGNNKYYADSVKGRFTISRDNSKNTLYLQMNSLRGEDTAVYYCARVYYGSGSYYKNRYYYGMDVWGQGTTVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1250 - protein, 457 aa, Artificial Sequence
  Synthetic Peptide
QVQLVESGGGVVQPGRSLRLSCAVSGFTFSSNGMHWVRQAPGKGLEWVAVISNDGSNKYYGDSVKGRFTISRDNSKNTLYLQMNSLRAEDTAVYYCAKVYYGSGIYYRNNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1251 - protein, 457 aa, Artificial Sequence
  Synthetic Peptide
QVQVVESGGGVVQPGRSLRLSCGASGFTFSGYGMHWVRQAPGKGLEWVAVISYDGSNKYYADSVKGRFPISRDNSKNTLYLQMNSLRGEDTAVYYCARVYYGSGIYYKNRYYYGMDVWGQGTTVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1252 - protein, 457 aa, Artificial Sequence
  Synthetic Peptide
QVQVVESGGGVVQPGRSLRLSCGASGFTFSGYGMHWVRQAPGKGLEWVAVISYDGSNKYYADSVKGRFTISRDNSKNTLYLQMNSLRGEDTAVYYCARVYYGSGIYYKNRYYYGMDVWGQGTTVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1253 - protein, 457 aa, Artificial Sequence
  Synthetic Peptide
QVQLVESGGGVVQPGRSLRLSCAASGLNFSNFGMHWVRQAPGKGLDWVAVISYDGGNKYYADSVKGRFTVSRDNSKNTLFLQMNSLRAEDTALYYCAKVYYGSGSYYKKRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1254 - protein, 457 aa, Artificial Sequence
  Synthetic Peptide
QVQLVESGGGVVQPGRSLRLSCAASGFNFSSCGMHWVRQAPGKGLEWVAVISYDGTNKYYADSVKGRFTISRDNSKNTLYLQMNSLRAEDTAVYYCAKVYYGSGIYYKKNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

We claim:

1. An antibody that binds to human C—C chemokine receptor type 8 (CCR8), the antibody comprising:
   (a) a heavy chain complementarity-determining region (HCDR) 1 amino acid sequence comprising SEQ ID NO: 839;
   (b) an HCDR2 amino acid sequence comprising SEQ ID NO: 840,
   (c) an HCDR3 amino acid sequence comprising SEQ ID NO: 841,
   (d) a light chain complementarity-determining region (LCDR) 1 amino acid sequence comprising SEQ ID NO: 842,
   (e) an LCDR2 amino acid sequence comprising SEQ ID NO: 843, and
   (f) an LCDR3 amino acid sequence comprising SEQ ID NO: 844.

2. The antibody of claim 1, the antibody comprising:
   a heavy chain variable region (HCVR) amino acid sequence of comprising SEQ ID NO: 1017, and
   a light chain variable region (LCVR) comprising the amino acid sequence: DIVMTQSPD-SLAVSLGERATINCKSSQSVLYSSN-NXINYLAWYX$_2$QKPGQX$_3$PKLLIS WAST-RESGVPDRFSGSGSGTDFTLTINSLQAEDVA-VYYCQQYYSIPITFGGGTKVEIK R (SEQ ID NO: 1236),
   wherein $X_1$ is R, $X_2$ is H or Q, and $X_3$ is S or P.

3. The antibody of claim 1, the antibody comprising:
   a HCVR amino acid sequence of SEQ ID NO: 1017, and
   a LCVR amino acid sequence of SEQ ID NO: 1018.

4. A pharmaceutical composition comprising the antibody of claim 3 and a pharmaceutically acceptable carrier.

5. The antibody of claim 1, the antibody comprising:
   a heavy chain (HC) amino acid sequence comprising SEQ ID NO: 1125, and
   a light chain (LC) amino acid sequence comprising SEQ ID NO: 1126.

6. The antibody of claim 1, which is an afucosylated antibody.

7. A pharmaceutical composition comprising the antibody of claim 1 and a pharmaceutically acceptable carrier.

8. A method of inhibiting further progression of cancer in a patient, comprising administering an effective amount of a pharmaceutical composition comprising the antibody of claim 1 to the patient, wherein the cancer is non-small cell lung cancer, gastric cancer, head and neck squamous cell carcinoma, hepatocellular carcinoma, triple-negative breast cancer, colorectal cancer, pancreatic cancer, or metastatic castrate-resistant prostate cancer.

9. The method of claim 8, which further comprises administering an effective amount of a PD-1 antagonist antibody to the patient, wherein said PD-1 antagonist binds to PD-1 and decreases or blocks signal transduction resulting from the interaction of PD-1 and one or more of its ligands.

10. The method of claim 8, wherein the cancer is non-small cell lung cancer.

11. An antibody that binds to human C—C chemokine receptor type 8 (CCR8), wherein said antibody is obtained by a process comprising cultivating a mammalian cell comprising a vector comprising:
- a nucleic acid sequence encoding a heavy chain (HC) comprising an HCDR1 amino acid sequence comprising SEQ ID NO: 839, an HCDR2 amino acid sequence comprising SEQ ID NO: 840, and an HCDR3 amino acid sequence comprising SEQ ID NO: 841, and
- a nucleic acid sequence encoding a light chain (LC) comprising an LCDR1 amino acid sequence comprising SEQ ID NO: 842, an LCDR2 amino acid sequence comprising SEQ ID NO: 843, and an LCDR3 amino acid sequence comprising SEQ ID NO: 844,
- under conditions such that the antibody is expressed and recovering the expressed antibody.

12. The antibody of claim 11, wherein said antibody is obtained by a process comprising cultivating a mammalian cell comprising a vector comprising:
- a nucleic acid sequence encoding a HCVR amino acid sequence at least 90% identical to SEQ ID NO: 1017, and
- a nucleic acid sequence encoding a LCVR amino acid sequence at least 90% identical to SEQ ID NO: 1018,
- under conditions such that the antibody is expressed and recovering the expressed antibody.

13. The antibody of claim 11, wherein said antibody is obtained by a process comprising cultivating a mammalian cell comprising a vector comprising:
- a nucleic acid sequence encoding a HCVR amino acid sequence comprising SEQ ID NO: 1017, and
- a nucleic acid sequence encoding a LCVR amino acid sequence comprising SEQ ID NO: 1018,
- under conditions such that the antibody is expressed and recovering the expressed antibody.

14. The antibody of claim 11, wherein said antibody is obtained by a process comprising cultivating a mammalian cell comprising a vector comprising:
- a nucleic acid sequence encoding a HC amino acid sequence at least 90% identical to SEQ ID NO: 1125 or SEQ ID NO: 1237, and
- a nucleic acid sequence encoding a LC amino acid sequence at least 90% identical to SEQ ID NO: 1126,
- under conditions such that the antibody is expressed and recovering the expressed antibody.

15. The antibody of claim 11, wherein said antibody is obtained by a process comprising cultivating a mammalian cell comprising a vector comprising:
- a nucleic acid sequence encoding a HC amino acid sequence comprising SEQ ID NO: 1125 or SEQ ID NO: 1237, and
- nucleic acid sequence encoding a LC amino acid sequence comprising SEQ ID NO: 1126,
- under conditions such that the antibody is expressed and recovering the expressed antibody.

16. An antibody that binds to human C—C chemokine receptor type 8 (CCR8), wherein said antibody is obtained by a process comprising cultivating a mammalian cell comprising: a vector comprising a nucleic acid sequence encoding an HCR1 amino acid sequence comprising SEQ ID NO: 839, an HCR2 amino acid sequence comprising SEQ ID NO: 840, and an HCDR3 amino acid sequence comprising SEQ ID NO: 841, and a vector comprising a nucleic acid sequence encoding an LCDR1 amino acid sequence comprising SEQ ID NO: 842, an LCDR2 amino acid sequence comprising SEQ ID NO: 843, and an LCDR3 amino acid sequence comprising SEQ ID NO: 844, under conditions such that the antibody is expressed and recovering the expressed antibody.

17. A single chain variable fragment (scFv), Fab, or single chain Fab (scFab) that binds to human C—C chemokine receptor type 8 (CCR8), wherein said scFv, Fab, or scFab comprises:
(a) an HCDR1 amino acid sequence comprising SEQ ID NO: 839;
(b) an HCDR2 amino acid sequence comprising SEQ ID NO: 840,
(c) an HCDR3 amino acid sequence comprising SEQ ID NO: 841,
(d) an LCDR1 amino acid sequence comprising SEQ ID NO: 842,
(e) an LCDR2 amino acid sequence comprising SEQ ID NO: 843, and
(f) an LCDR3 amino acid sequence comprising SEQ ID NO: 844.

18. The scFv, Fab, or scFab of claim 17, the scFv, Fab, or scFab comprising:
a heavy chain variable region (HCVR) amino acid sequence comprising SEQ ID NO: 1017, and
a light chain variable region (LCVR) comprising the amino acid sequence: DIVMTQSPDSLAVSLGERAT-INCKSSQSVLYSSNNXINYLAWYX$_2$QKPGQX$_3$P KLLISWASTRESGVPDRFSGSGSGTDFTLTIN-SLQAEDVAVYYCQQYYSIPITF GGGTKVEIKR (SEQ ID NO: 1236),
wherein X$_1$ is R, X$_2$ is H or Q, and X$_3$ is S or P.

19. The scFv, Fab, or scFab of claim 17, the scFv, Fab, or scFab comprising:
a LCVR comprising the amino acid sequence comprising SEQ ID NO: 1018, and
a HCVR amino acid sequence comprising SEQ ID NO: 1017.

20. An antibody that binds to human C—C chemokine receptor type 8 (CCR8), the antibody comprising:
a heavy chain (HC) amino acid sequence comprising SEQ ID NO: 1237, and
a light chain (LC) amino acid sequence comprising SEQ ID NO: 1126.

21. A pharmaceutical composition comprising the antibody of claim 20 and a pharmaceutically acceptable carrier.

22. An antibody that binds to human C—C chemokine receptor type 8 (CCR8), the antibody comprising:
(a) an HCDR1 amino acid sequence comprising SEQ ID NO: 839;
(b) an HCDR2 amino acid sequence comprising SEQ ID NO: 840,
(c) an HCDR3 amino acid sequence comprising SEQ ID NO: 841,
(d) an LCDR1 amino acid sequence comprising SEQ ID NO: 950, (e) an LCDR2 amino acid sequence comprising SEQ ID NO: 843, and (f) an LCDR3 amino acid sequence comprising SEQ ID NO: 844.

23. The antibody of claim 22, wherein said antibody comprises:
an HCVR amino acid sequence of SEQ ID NO: 1017, and
an LCVR amino acid sequence of SEQ ID NO: 353.

24. The antibody of claim 22, comprising:
a HC amino acid sequence comprising SEQ ID NO: 1125 or SEQ ID NO: 1237, and
a LC amino acid sequence of SEQ ID NO: 355.

25. The antibody of claim 22, comprising:
a HC amino acid sequence comprising SEQ ID NO: 1237, and
a LC amino acid sequence of SEQ ID NO: 355.

26. The antibody of claim 22, comprising:
a HC amino acid sequence comprising SEQ ID NO: 1125, and
a LC amino acid sequence comprising SEQ ID NO: 355.

27. An antibody that binds to human C—C chemokine receptor type 8 (CCR8), the antibody comprising:
(a) a heavy chain complementarity-determining region (HCDR) 1 amino acid sequence consisting of SEQ ID NO: 839;
(b) an HCDR2 amino acid sequence consisting of SEQ ID NO: 840,
(c) an HCDR3 amino acid sequence consisting of SEQ ID NO: 841,
(d) a light chain complementarity-determining region (LCDR) 1 amino acid sequence consisting of SEQ ID NO: 842,
(e) an LCDR2 amino acid sequence consisting of SEQ ID NO: 843, and
(f) an LCDR3 amino acid sequence consisting of SEQ ID NO: 844.

28. The antibody of claim 27, the antibody comprising:
a heavy chain (HC) amino acid sequence consisting of SEQ ID NO: 1237, and
a light chain (LC) amino acid sequence consisting of SEQ ID NO: 1126.

29. The antibody of claim 27, the antibody comprising:
a HCVR amino acid sequence consisting of SEQ ID NO: 1017, and
a LCVR amino acid sequence consisting of SEQ ID NO: 1018.

* * * * *

UNITED STATES PATENT AND TRADEMARK OFFICE
CERTIFICATE OF CORRECTION

PATENT NO. : 12,258,411 B2  
APPLICATION NO. : 17/831398  
DATED : March 25, 2025  
INVENTOR(S) : Nathan William Pierce et al.

Page 1 of 1

It is certified that error appears in the above-identified patent and that said Letters Patent is hereby corrected as shown below:

In the Claims

In Claim 2 at Column 351, Line 67, replace "DIVMTQSPDSLAVSLGERATINCKSSQSVLYSSNNXINYLAWYX$_2$QKPGQX$_3$PKLLISWASTRESGVPDRFSGSGSGTDFTLTINSLQAEDVAVYYCQQYYSIPITFGGGTKVEIKR (SEQ ID NO: 1236)" with --DIVMTQSPDSLAVSLGERATINCKSSQSVLYSSNNX$_1$NYLAWYX$_2$QKPGQX$_3$PKLLISWASTRESGVPDRFSGSGSGTDFTLTINSLQAEDVAVYYCQQYYSIPITFGGGTKVEIKR (SEQ ID NO: 1236)--.

In Claim 16 at Column 354, Line 7, replace "encoding an HCR1 amino acid" with --encoding a heavy chain (HC) comprising an HCDR1 amino acid--.
In Claim 16 at Column 354, Line 8, replace "an HCR2 amino acid" with --an HCDR2 amino acid--.
In Claim 16 at Column 354, Line 11, replace "encoding an LCDR1 amino acid" with --encoding a light chain (LC) comprising an LCDR1 amino acid--.

In Claim 18 at Column 354, Line 38, replace "DIVMTQSPDSLAVSLGERATINCKSSQSVLYSSNNXINYLAWYX$_2$QKPGQX$_3$PKLLISWASTRESGVPDRFSGSGSGTDFTLTINSLQAEDVAVYYCQQYYSIPITF GGGTKVEIKR (SEQ ID NO: 1236)" with --DIVMTQSPDSLAVSLGERATINCKSSQSVLYSSNNX$_1$NYLAWYX$_2$QKPGQX$_3$PKLLISWASTRESGVPDRFSGSGSGTDFTLTINSLQAEDVAVYYCQQYYSIPITFGGGTKVEIKR (SEQ ID NO: 1236)--.

Signed and Sealed this  
Tenth Day of June, 2025

Coke Morgan Stewart  
*Acting Director of the United States Patent and Trademark Office*